US012624361B2

(12) United States Patent
Xu et al.

(10) Patent No.: US 12,624,361 B2
(45) Date of Patent: May 12, 2026

(54) FUSION PROTEINS FOR DNA BASE EDITING

(71) Applicant: SYNGENTA CROP PROTECTION AG, Basel (CH)

(72) Inventors: Jianping Xu, Beijing (CN); Jiang Li, Beijing (CN)

(73) Assignee: Syngenta Crop Protection AG, Basel (CH)

( * ) Notice: Subject to any disclaimer, the term of this patent is extended or adjusted under 35 U.S.C. 154(b) by 740 days.

(21) Appl. No.: 17/763,384

(22) PCT Filed: Sep. 18, 2020

(86) PCT No.: PCT/US2020/051383
§ 371 (c)(1),
(2) Date: Mar. 24, 2022

(87) PCT Pub. No.: WO2021/061507
PCT Pub. Date: Apr. 1, 2021

(65) Prior Publication Data
US 2022/0403396 A1      Dec. 22, 2022

(30) Foreign Application Priority Data
Sep. 26, 2019    (WO) ................ PCT/CN2019/108026

(51) Int. Cl.
*C12N 9/78*      (2006.01)
*C12N 15/01*      (2006.01)
*C12N 15/62*      (2006.01)
*C12N 15/82*      (2006.01)

(52) U.S. Cl.
CPC .............. *C12N 15/62* (2013.01); *C12N 9/78* (2013.01); *C12N 15/01* (2013.01); *C12N 15/8213* (2013.01); *C12Y 305/04005* (2013.01); *C12N 2310/20* (2017.05)

(58) Field of Classification Search
CPC .......... C12N 15/62; C12N 9/78; C12N 15/01; C12N 15/8213; C12N 2310/20; C12N 15/8245; C12N 9/22; C12N 15/102; C12Y 305/04005; C07K 2319/09; C07K 2319/80; C07K 2319/00
See application file for complete search history.

(56) References Cited

U.S. PATENT DOCUMENTS

| | | | |
|---|---|---|---|
| 2010/0297219 A1 | 11/2010 | Smith et al. | |
| 2017/0121693 A1 | 5/2017 | Liu et al. | |
| 2020/0308571 A1* | 10/2020 | Joung ................. | C12N 15/102 |

FOREIGN PATENT DOCUMENTS

| | | |
|---|---|---|
| CN | 109321593 A | 2/2019 |
| CN | 109957569 A | 7/2019 |
| CN | 110157727 A | 8/2019 |
| KR | 20190065403 A | 6/2019 |
| WO | 2017015015 A1 | 1/2017 |
| WO | 2017070632 A2 | 4/2017 |
| WO | 2017184786 A1 | 10/2017 |
| WO | 2018027078 A1 | 2/2018 |
| WO | 2018039438 A1 | 3/2018 |
| WO | 2019139645 A2 | 7/2018 |
| WO | 2018165629 A1 | 9/2018 |
| WO | 2018176009 A1 | 9/2018 |
| WO | 2018213726 A1 | 11/2018 |
| WO | WO 2018/213708 A1 * | 11/2018 |
| WO | 2019023680 A1 | 1/2019 |
| WO | 2019/041296 A1 | 3/2019 |
| WO | 2019042284 A1 | 3/2019 |
| WO | 2019079347 A1 | 4/2019 |
| WO | 2019/126762 A2 | 6/2019 |
| WO | 2019120283 A1 | 6/2019 |
| WO | 2019120310 A1 | 6/2019 |
| WO | 2019126577 A2 | 6/2019 |
| WO | 2019161783 A1 | 8/2019 |
| WO | 2019226953 A1 | 11/2019 |

OTHER PUBLICATIONS

Witkowski et al., Biochemistry 38:11643-11650, 1999.*
Tang et al., Phil Trans R Soc B 368:20120318, 1-10, 2013.*
Seffernick et al., J. Bacteriol. 183(8):2405-2410, 2001.*
Singh et al., Current Protein and Peptide Science 19(1):5-15, 2018.*
Sadowski et al., Current Opinion in Structural Biology 19:357-362, 2009.*
Extended ESR for EP20868850.7, mailed on Oct. 2, 2023.
Eid A. et al., CRISPR base editors: genome editing without double-stranded breaks. Biochem. J. Jun. 11, 2018, vol. 475, No. 11, pp. 1955-1964.
International Search Report for International Application No. PCT/US2020/051383 mailed Feb. 9, 2021.
International Preliminary Report on Patentability for International Application No. PCT/CN2019/108026, mailed Apr. 7, 2022, 8 Pages.
Written Opinion for International Application No. PCT/CN2019/108026, mailed Jun. 19, 2020, 6 Pages.
International Search Report for International Application No. PCT/CN2019/108026 mailed Jun. 19, 2020.
IPRP for PCT/US2020/051383, mailed on Apr. 7, 2022.
Havlicek, S. et al., "Re-engineered RNA-Guided Fokl-Nucleases for Improved Genome Editing in Human Cells", Molecular Therapy, 25(2), pp. 342-355, Feb. 2017 (Feb. 2017).

* cited by examiner

*Primary Examiner* — Delia M Ramirez
(74) *Attorney, Agent, or Firm* — Amanda W. Bublitz

(57)      ABSTRACT

The present invention relates to methods and compositions for modifying a target site in the genome of a cell. Fusion proteins including one or more DNA binding domains and one or more heterologous domains, such as DNA modifying domains, connected by improved linker sequences are provided. Codon optimized polynucleotides encoding fusion proteins including one or more DNA binding domains and one or more heterologous domains connected by improved linker sequences are provided.

1 Claim, 2 Drawing Sheets
Specification includes a Sequence Listing.

FUSION PROTEINS FOR DNA BASE EDITING

RELATED APPLICATION INFORMATION

This application is a 371 of International Application No. PCT/US2020/051383, filed 18 Sep. 2020, which claims priority to PCT/CN2019/108026, filed 26 Sep. 2019, the contents of which are incorporated herein by reference herein.

FIELD OF THE INVENTION

The present invention relates to methods and compositions for targeted nucleotide base editing in the genome of a cell.

STATEMENT REGARDING ELECTRONIC SUBMISSION OF A SEQUENCE LISTING

A Sequence Listing in ASCII text format, submitted under 37 C.F.R. § 1.821, entitled "81945_USNPE_ST25.txt", created Mar. 23, 2022, approximately 702 kilobytes, is attached and filed herewith and is incorporated herein by reference.

BACKGROUND OF THE INVENTION

There is a great need in agriculture to have the capability to edit the genome of plants in order to create favorable alleles. It could be possible to increase yields or prevent disease. Genome editing is a new field where progress in plants is lagging behind. Further, changes to the genome other than the intended change are a problem which limits application of the desired changes. CRISPR-CAS9 works by making a double stranded cut to the DNA. As this break is repaired by non-homologous end joining or homology dependent repair, DNA base insertions or deletions may occur. A strategy called base editing makes changes to the DNA without cutting and creating insertions and deletions. In one version, an enzyme called a cytidine deaminase is targeted to a specific base by a CAS9 (Shimatani et al, 2017. Nat. Biotechnol. 35, 441-443) or a CAS12a (Li et al, 2018. Nat. Biotechnol. 36, 324-327) enzyme which is modified so that it cannot cut DNA. The cytidine deaminase and the nuclease deficient CAS9 or CAS12a are fused together by a connection through an amino acid linker. Improvements in the linker connection can improve the functionality of the fusion protein such as by improving the precision of the cutting by reducing off target base changes.

SUMMARY OF THE INVENTION

To meet this need for improvements, we provide an optimized and improved Cas12a enzyme and construct. In particular, we provide a fusion protein comprising a heterologous domain, a first linker sequence, and a Type V CRISPR-Cas enzyme. The first linker sequence comprises a repeated GGGGS sequence. The heterologous domain can be a deaminase, polymerase, nuclease, relaxase, alkyltransferase, methyltransferase, adenosine deaminase, cytidine deaminase, oxidase, thymine alkyltransferase, adenine oxidase, adenosine methyltransferase, glycosylase or nuclear localization signal. For base editing, the heterologous domain is a deaminase domain—such as a cytidine deaminase or an adenine deaminase. The cytidine deaminase domain may be an activation-induced cytidine deaminase ("AID"), or an apolipoprotein B mRNA-editing complex ("APOBEC") domain such as from the APOBEC1 family of deaminases. In some contexts, the APOBEC domain comprises a sequence at least 70% identical to SEQ ID NO: 1. Where an adenine deaminase is required, the adenine deaminase may be a TadA domain comprising an amino acid sequence at least 70% identical to SEQ ID NO: 92.

Where the type V CRISPR-Cas enzyme is a type V-A ("Cas12a") enzyme, the Cas12a is selected from the group comprised of SEQ ID NO: 3, SEQ ID NO: 6, SEQ ID NO: 22, SEQ ID NO: 45, SEQ ID NO: 46, SEQ ID NO: 47, and SEQ ID NO: 48. The Cas12a domain may be catalytically inactive, but still binds to the target DNA and allows the heterologous domain to operate. Where the Cas12a is inactive, its sequence is SEQ ID NO: 3, SEQ ID NO: 6, or SEQ ID NO: 22.

The first linker sequence between the heterologous domain and the Cas12a enzyme may comprise GGGGS repeated at least three times. In other uses, the first linker sequence may comprise GGGGS repeated at least six times. The fusion protein may comprise SEQ ID NO: 11, 12, 13, or 44, and it may also include a uracil DNA glycosylase inhibitor ("UGI") domain (as represented by SEQ ID NO: 8). The UGI domain may be linked to the Cas12a enzyme by a second linker comprising the sequence SGGS. The fusion protein may comprise SEQ ID NO: 17, SEQ ID NO: 24, SEQ ID NO: 35, SEQ ID NO: 39, SEQ ID NO: 43, SEQ ID NO: 50, SEQ ID NO: 52, SEQ ID NO: 54, SEQ ID NO: 56, SEQ ID NO: 81, SEQ ID NO: 83, SEQ ID NO: 85, SEQ ID NO:87, or SEQ ID NO:89. These fusion proteins, when contacted with DNA, produces on-target edits at an increased frequency and off-target edits at a reduced frequency compared to prior art fusion proteins which lack a first linker sequence of a repeated GGGGS sequence.

We also provide a method of editing plant genomic DNA by contacting plant genomic DNA with: (a) a fusion protein as described by one of the above aspects and optionally comprising a UGI domain; and (b) a guide RNA ("gRNA") targeting the fusion protein of step (a) to a target DNA sequence of the plant genomic DNA; where the edited plant genomic DNA comprises reduced off-target edits compared to plant genomic DNA edited by a fusion protein having a first linker other than a repeated GGGGS sequence.

We also provide a method of editing plant genomic DNA with reduced off-target edits by contacting plant genomic DNA with: (a) the fusion protein as described by one of the above aspects and optionally comprising a UGI domain; and (b) a guide RNA ("gRNA") targeting the fusion protein of step (a) to a target DNA sequence of the plant genomic DNA; where the edited plant genomic DNA comprises reduced off-target edits compared to plant genomic DNA edited by a fusion protein having a first linker other than a repeated GGGGS sequence. In one aspect, the fusion protein comprises SEQ ID NO: 24.

We also provide a method of obtaining a population of edited plants with reduced off-target edits by: (a) obtaining a population of plant cells comprising genomic DNA to be edited; (b) obtaining a nucleotide sequence encoding the fusion protein as described by one of the above aspects and optionally a UGI domain; (c) transforming the population of plant cells with the nucleotide sequence of step (b), thereby expressing the fusion protein encoded by the nucleic acid sequence within the population of plant cells; (d) growing the transformed population of plant cells into plants, wherein at least one of the plants is edited; and (e) selecting the at least one edited plant from the product of step (d), thereby obtaining a population of edited plants; wherein the population of edited plants comprises reduced off-target edits compared to plants edited by a fusion protein having a first linker other than a repeated GGGGS sequence. In one aspect, the nucleotide sequence encoding the fusion protein comprises, SEQ ID NO: 17, SEQ ID NO: 24, SEQ ID NO: 35, SEQ ID NO: 39, SEQ ID NO: 43, SEQ ID NO: 50, SEQ ID NO: 52, SEQ ID NO: 54, SEQ ID NO: 56, SEQ ID NO: 81, SEQ ID NO: 83, SEQ ID NO: 85, SEQ ID NO:87, or SEQ ID NO:89.

BRIEF DESCRIPTION OF THE FIGURES

FIG. 1A shows the LbCas12aBE plus guide RNA construct in the 5' to 3' direction, where the deaminase (3) is operably linked to LbCas12a (5) by an XTEN linker (4). FIG. 1B shows the LbCas12aBE plus guide RNA construct in the 5' to 3' direction, where the deaminase (3) is operably linked to LbCas12a (5) by a $(G_4S)_6$ linker (8). FIG. 1C shows the Mb2Cas12aBE plus guide RNA construct in the 5' to 3' direction, where the deaminase (3) is operably linked to Mb2Cas12a (9) by a $(G_4S)_6$ linker (8).

BRIEF DESCRIPTION OF THE SEQUENCES IN THE SEQUENCE LISTING

Figure 1:
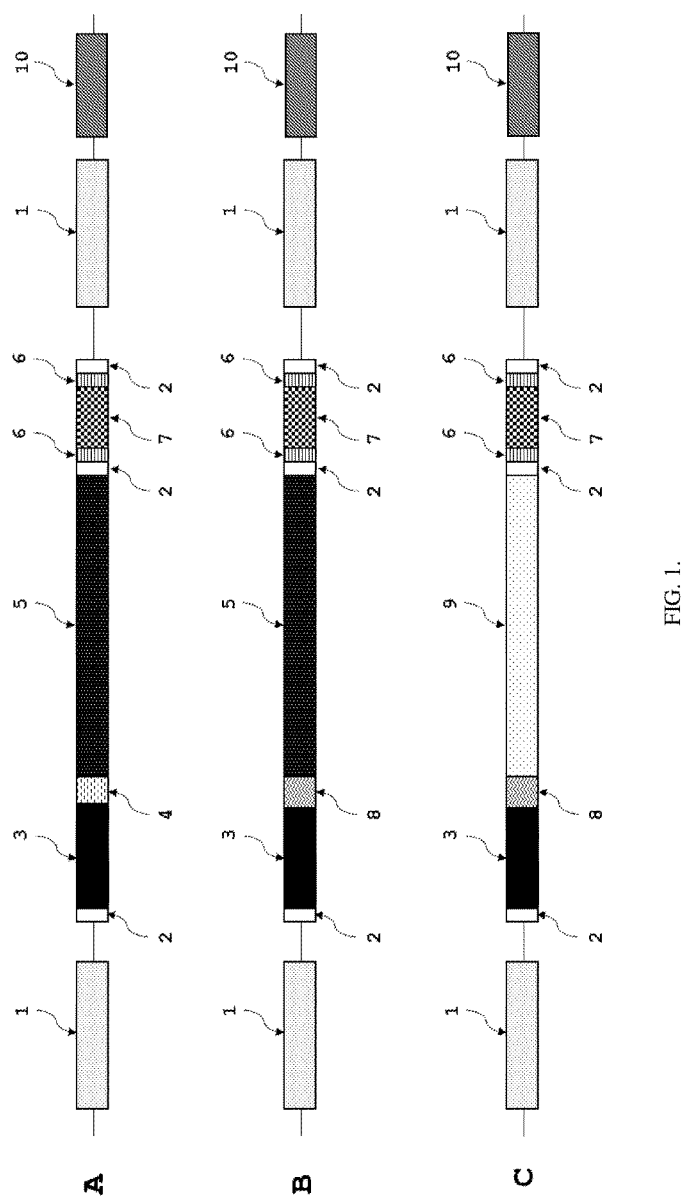
FIG. 1 shows the schematic representations of three versions of DNA constructs for Cas12aBE. (1) denotes a promoter; (2) is a nuclear localization signal; (3) is a deaminase, for example, an APOBEC deaminase; (4) is an XTEN linker; (5) is LbCas12a; (6) is an SGGS linker; (7) is a uracil glycosylase inhibitor; (8) is a long linker, e.g., $(G_4S)_6$ linker; (9) is Mb2Cas12a; (10) is a guide RNA-encoding element.
Figure 2:
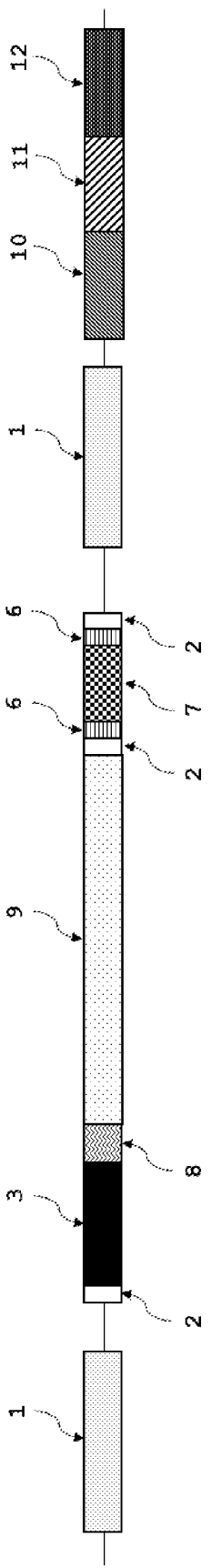
FIG. 2 shows the schematic representation of the DNA construct, in the 5' to 3' direction, comprising a Cas12aBE and multiplexed guide RNAs. (1) denotes a promoter; (2) is a nuclear localization signal; (3) is a deaminase, for example, an APOBEC deaminase; (6) is an SGGS linker; (7) is a uracil glycosylase inhibitor; (8) is a long linker, e.g., $(G_4S)_6$ linker; (9) is a Cas12a; (10) is a first guide RNA-encoding element; (11) is a second guide RNA-encoding element; and (12) is a third guide RNA-encoding element. Each guide RNA-encoding element comprises a crRNA segment and a target sequence segment capable of hybridizing to the genomic target DNA sequence.

SEQ ID NO: 1 is an amino acid sequence of Apobec1.
SEQ ID NO: 2 is a nucleotide sequence of Apobec1.
SEQ ID NO: 3 is an amino acid sequence of catalytically inactive Mb2Cas12a.
SEQ ID NO: 4 is a nucleotide sequence of catalytically inactive Mb2Cas12a.
SEQ ID NO: 5 is a nucleotide sequence of catalytically inactive cLbCas12aBE.
SEQ ID NO: 6 is an amino acid sequence of catalytically inactive cLbCas12aBE.
SEQ ID NO: 7 is a nucleotide sequence of a uracil DNA glycosylase inhibitor (UGI).
SEQ ID NO: 8 is an amino acid sequence of a uracil DNA glycosylase inhibitor (UGI).
SEQ ID NO: 9 is a nucleotide sequence comprising the expression cassette prSoUbi4:SV4ONLS:cLbCas12aBE: GS6Linker:SV40NLS:SGGSLinker:UGI:SGGSLinker: SV40NLS:tNOS.
SEQ ID NO: 10 is a nucleotide sequence Optimized (G4S)x6 Linker.
SEQ ID NO: 11 is an amino acid sequence for Optimized (G4S)x6 Linker.

SEQ ID NO: 12 is an amino acid sequence for 18 aa linker-SX.
SEQ ID NO: 13 is an amino acid sequence for 15 aa linker-(G4S)X3.
SEQ ID NO: 14 is a nucleotide sequence comprising the fusion protein cLBCas12aBE-07 from construct 25057.
SEQ ID NO: 15 is an amino acid sequence comprising the fusion protein cLBCas12aBE-07 from construct 25057.
SEQ ID NO: 16 is a nucleotide sequence comprising the fusion protein cLBCas12aBE-08 from construct 25058.
SEQ ID NO: 17 is an amino acid sequence comprising the fusion protein cLBCas12aBE-08 from construct 25058.
SEQ ID NO: 18 is a nucleotide sequence comprising the fusion protein cLBCas12aBE-01 from construct 24524.
SEQ ID NO: 19 is an amino acid sequence comprising the fusion protein cLBCas12aBE-01 from construct 24524.
SEQ ID NO: 20 is a nucleotide sequence for cCas9BE-02.
SEQ ID NO: 21 is an amino acid sequence for cCas9BE-02.
SEQ ID NO: 22 is an amino acid sequence for catalytically inactive AsCas12a.
SEQ ID NO: 23 is a nucleotide sequence comprising the fusion protein cLBCas12aBE-06 from construct 24904.
SEQ ID NO: 24 is an amino acid sequence comprising the fusion protein cLBCas12aBE-06 from construct 24904.
SEQ ID NO: 25 is a nucleotide sequence comprising the promoter prSoUbi4-02.
SEQ ID NO: 26 is a nucleotide sequence comprising the Cas12a gRNA waxy1 target sequence.
SEQ ID NO: 27 is a nucleotide sequence comprising the Cas9 gRNA waxy1 target sequence.
SEQ ID NO: 28 is a nucleotide sequence comprising ZmWaxy1 gene exon 4.
SEQ ID NO: 29 is the forward primer for ZmWaxy1.
SEQ ID NO: 30 is the reverse primer for ZmWaxy1.
SEQ ID NO: 31 is the sequencing primer for ZmWaxy1.
SEQ ID NO: 32 is a nucleotide sequence comprising the fusion protein cLbCpf1-02 from construct 24523.
SEQ ID NO: 33 is an amino acid sequence comprising the fusion protein cLbCpf1-02 from construct 24523.
SEQ ID NO: 34 is a nucleotide sequence comprising the fusion protein cLbCas12a-05 from construct 25181.
SEQ ID NO: 35 is an amino acid sequence comprising the fusion protein cLbCas12a-05 from construct 25181.
SEQ ID NO: 36 is a nucleotide sequence comprising the fusion protein cLbCas12a-02 from construct 25205.
SEQ ID NO: 37 is an amino acid sequence comprising the fusion protein cLbCas12a-02 from construct 25205.
SEQ ID NO: 38 is a nucleotide sequence comprising the fusion protein cLbCas12a-25 from construct 25513.
SEQ ID NO: 39 is an amino acid sequence comprising the fusion protein cLbCas12a-25 from construct 25513.
SEQ ID NO: 40 is a nucleotide sequence comprising the fusion protein cMb2Cas12a-01 from construct 25220.
SEQ ID NO: 41 is an amino acid sequence comprising the fusion protein cMb2Cas12a-01 from construct 25220.
SEQ ID NO: 42 is a nucleotide sequence comprising the fusion protein cMb2Cas12a-02 from construct 25382.
SEQ ID NO: 43 is an amino acid sequence comprising the fusion protein cMb2Cas12a-02 from construct 25382.
SEQ ID NO: 44 is an amino acid sequence for Optimized (G4SG)x6 Linker.
SEQ ID NO: 45 is an amino acid sequence for active LbCas12a.
SEQ ID NO: 46 is an amino acid sequence for active Mb2Cas12a.

SEQ ID NO: 47 is an amino acid sequence for active AsCas12a.

SEQ ID NO: 48 is an amino acid sequence for active FnCas12a.

SEQ ID NO: 49 is a nucleotide sequence comprising the fusion protein cMb2Cas12a-BE-01 from construct 25457.

SEQ ID NO: 50 is an amino acid sequence comprising the fusion protein cMb2Cas12a-BE-01 from construct 25457.

SEQ ID NO: 51 is a nucleotide sequence comprising the fusion protein cLbCas12a-BE-08 from construct 25268.

SEQ ID NO: 52 is an amino acid sequence comprising the fusion protein cLbCas12a-BE-08 from construct 25268.

SEQ ID NO: 53 is a nucleotide sequence comprising the fusion protein cLbCas12a-05 from construct 25173.

SEQ ID NO: 54 is an amino acid sequence comprising the fusion protein cLbCas12a-05 from construct 25173.

SEQ ID NO: 55 is a nucleotide sequence comprising the fusion protein cLbCas12a-05 from construct 25175.

SEQ ID NO: 56 is an amino acid sequence comprising the fusion protein cLbCas12a-05 from construct 25175.

SEQ ID NO: 57 is an amino acid sequence of catalytically inactive LbCas12a with the optimized (G4SG)6 linker.

SEQ ID NO: 58 is an amino acid sequence of active Mb2Cas12a with the optimized (G4S)6 linker.

SEQ ID NO: 59 is an amino acid sequence of catalytically inactive Mb2Cas12a with the XTEN linker.

SEQ ID NO: 60 is an amino acid sequence of active AsCas12a with the XTEN linker.

SEQ ID NO: 61 is an amino acid sequence of catalytically inactive AsCas12a with the XTEN linker.

SEQ ID NO: 62 is an amino acid sequence of active FnCas12a with the XTEN linker.

SEQ ID NO: 63 is an amino acid sequence of active AsCas12a with the optimized (G4S)6 linker.

SEQ ID NO: 64 is an amino acid sequence of catalytically inactive AsCas12a with the optimized (G4S)6 linker.

SEQ ID NO: 65 is an amino acid sequence of active FnCas12a with the optimized (G4S)6 linker.

SEQ ID NO: 66 is an amino acid sequence of catalytically inactive Mb2Cas12a with the optimized (G4SG)6 linker.

SEQ ID NO: 67 is an amino acid sequence of active AsCas12a with the optimized (G4SG)6 linker.

SEQ ID NO: 68 is an amino acid sequence of catalytically inactive AsCas12a with the optimized (G4SG)6 linker.

SEQ ID NO: 69 is an amino acid sequence of active FnCas12a with the optimized (G4SG)6 linker.

SEQ ID NO: 70 is an amino acid sequence of the XTEN linker.

SEQ ID NO: 71 is a nucleotide sequence comprising the Cas12a gRNA SBEII target sequence.

SEQ ID NO: 72 is a nucleotide sequence comprising the Cas12a gRNA GL2 target sequence.

SEQ ID NO: 73 is a nucleotide sequence comprising the Cas12a gRNA Fad2 target sequence.

SEQ ID NO: 74 is a nucleotide sequence comprising a Cas12a crRNA sequence used with waxy1, SBEII, and Fad2 target sequences.

SEQ ID NO: 75 is a nucleotide sequence comprising a Cas12a crRNA sequence used with a GL2 target sequence.

SEQ ID NO: 76 is a nucleotide sequence comprising the fusion protein cCas9ABE-01 from construct 24785.

SEQ ID NO: 77 is an amino acid sequence comprising the fusion protein cCas9ABE-01 from construct 24785.

SEQ ID NO: 78 is a nucleotide sequence comprising the fusion protein cLbCas1aABE-01 from construct 25459.

SEQ ID NO: 79 is an amino acid sequence comprising the fusion protein cLbCas1aABE-01 from construct 25459

SEQ ID NO: 80 is a nucleotide sequence comprising the fusion protein cLbCas12aABE-02 from construct 25504.

SEQ ID NO: 81 is an amino acid sequence comprising the fusion protein cLbCas12aABE-02 from construct 25504.

SEQ ID NO: 82 is a nucleotide sequence comprising the fusion protein cLbCas12aBE-09 from construct 25289.

SEQ ID NO: 83 is an amino acid sequence comprising the fusion protein cLbCas12aBE-09 from construct 25289

SEQ ID NO: 84 is a nucleotide sequence comprising the fusion protein cdLbCas12a-ABE-CBE-01 from construct 25658.

SEQ ID NO: 85 is an amino acid sequence comprising the fusion protein cdLbCas12a-ABE-CBE-01 from construct 25658.

SEQ ID NO: 86 is a nucleotide sequence comprising the fusion protein cdLbCas12a-ABE-CBE-02 from construct 25701.

SEQ ID NO: 87 is an amino acid sequence comprising the fusion protein cdLbCas12a-ABE-CBE-02 from construct 25701.

SEQ ID NO: 88 is a nucleotide sequence comprising the fusion protein cdLbCas12a-ABE-CBE-03 from construct 25702.

SEQ ID NO: 89 is an amino acid sequence comprising the fusion protein cdLbCas12a-ABE-CBE-03 from construct 25702.

SEQ ID NO: 90 is a nucleotide sequence comprising the Cas12a gRNA ADH1 target sequence.

SEQ ID NO: 91 is a nucleotide sequence comprising the TadA dimer.

SEQ ID NO: 92 is an amino acid sequence comprising the TadA dimer.

DETAILED DESCRIPTION OF THE INVENTION

This description is not intended to be a detailed catalogue of all the different ways in which the invention may be implemented, or all the features that may be added to the instant invention. For example, features illustrated with respect to one embodiment may be incorporated into other embodiments, and features illustrated with respect to a particular embodiment may be deleted from that embodiment. In addition, numerous variations and additions to the various embodiments suggested herein will be apparent to those skilled in the art in light of the instant disclosure, which do not depart from the instant invention. Hence, the following descriptions are intended to illustrate some particular embodiments of the invention, and not to exhaustively specify all permutations, combinations and variations thereof.

Definitions

Unless otherwise defined, all technical and scientific terms used herein have the same meaning as commonly understood by one of ordinary skill in the art to which this invention belongs. The terminology used in the description of the invention herein is for the purpose of describing particular embodiments only and is not intended to be limiting of the invention. All publications, patent applications, patents, and other references mentioned herein are incorporated by reference in their entirety.

The following definitions and methods are provided to better define the present invention and to guide those of ordinary skill in the art in the practice of the present invention. Unless otherwise noted, terms used herein are to be understood according to conventional usage by those of ordinary skill in the relevant art. Definitions of common terms in molecular biology may also be found in Rieger et al., *Glossary of Genetics: Classical and Molecular, 5th* edition, Springer-Verlag, New York, 1994.

As used herein, the term "long linker" refers to a polypeptide chain of at least 10 amino acids used to link a heterologous domain to a protein of interest. By way of example and not limitation, a long linker may comprise the sequence GGGGSGGGGSGGGGSGGGGSGGGGSGGGGS (SEQ ID NO: 11), otherwise represented as $(G_4S)_6$ or (G4S)x6 or (G4S)*6. A long linker may comprise GGGGS-GGGGGSGGGGGSGGGGGSGGGGGSGGGGGSG (SEQ ID NO: 44), otherwise represented as $(G_4SG)_6$ or (G4SG)x6 or (G4SG)*6. The heterologous domains linked by a long linker to a protein include a cytidine deaminase, a guanine deaminases, a uracil glycosylase inhibitor ("UGI"), a nuclease, and any other proteinaceous domain which can be operably linked in a heterologous manner to a protein of interest. Such proteins of interest include, but are not limited to, site-directed nucleases (e.g., Cas9, Cas12a, Cas12b, Cas12i, Cas12j, or other CRISPR nucleases), zinc-fingers, meganucleases, transcription activator-like effector nucleases ("TALENs"), and the like.

As used in the description of the embodiments of the invention and the appended claims, the singular forms "a," "an," and "the" are intended to include the plural forms as well, unless the context clearly indicates otherwise.

As used herein, "and/or" refers to and encompasses any and all possible combinations of one or more of the associated listed items.

The term "about," as used herein when referring to a measurable value such as an amount of a compound, dose, time, temperature, and the like, is meant to encompass variations of 20%, 10%, 5%, 1%, 0.5%, or even 0.1% of the specified amount.

The terms "comprise," "comprises" and/or "comprising," when used in this specification, specify the presence of stated features, integers, steps, operations, elements, and/or components, but do not preclude the presence or addition of one or more other features, integers, steps, operations, elements, components, and/or groups thereof.

As used herein, the transitional phrase "consisting essentially of" means that the scope of a claim is to be interpreted to encompass the specified materials or steps recited in the claim and those that do not materially affect the basic and novel characteristic(s) of the claimed invention. Thus, the term "consisting essentially of" when used in a claim of this invention is not intended to be interpreted to be equivalent to "comprising."

As used herein, the term "amplified" means the construction of multiple copies of a nucleic acid molecule or multiple copies complementary to the nucleic acid molecule using at least one of the nucleic acid molecules as a template. See, e.g., Diagnostic Molecular Microbiology: Principles and Applications, D. H. Persing et al., Ed., American Society for Microbiology, Washington, D.C. (1993). The product of amplification is termed an amplicon.

A "coding sequence" is a nucleic acid sequence that is transcribed into RNA such as mRNA, rRNA, tRNA, snRNA, sense RNA or antisense RNA. In some embodiments, the RNA is then translated in an organism to produce a protein.

As used herein the term transgenic "event" refers to a recombinant plant produced by transformation and regeneration of a single plant cell with heterologous DNA, for example, an expression cassette that includes one or more genes of interest (e.g., transgenes). The term "event" refers to the original transformant and/or progeny of the transformant that include the heterologous DNA. The term "event" also refers to progeny produced by a sexual outcross between the transformant and another line. Even after repeated backcrossing to a recurrent parent, the inserted DNA and the flanking DNA from the transformed parent is present in the progeny of the cross at the same chromosomal location. Normally, transformation of plant tissue produces multiple events, each of which represent insertion of a DNA construct into a different location in the genome of a plant cell. Based on the expression of the transgene or other desirable characteristics, a particular event is selected. Thus, "event MIR604," "MIR604" or "MIR604 event" as used herein, means the original MIR604 transformant and/or progeny of the MIR604 transformant (U.S. Pat. Nos. 7,361, 813, 7,897,748, 8,354,519, and 8,884,102, incorporated by references herein).

"Expression cassette" as used herein means a nucleic acid molecule capable of directing expression of a particular nucleotide sequence in an appropriate host cell, comprising a promoter operably linked to the nucleotide sequence of interest, typically a coding region, which is operably linked to termination signals. It also typically comprises sequences required for proper translation of the nucleotide sequence. The coding region usually codes for a protein of interest but may also code for a functional RNA of interest, for example antisense RNA or a nontranslated RNA, in the sense or antisense direction. The expression cassette may also comprise sequences not necessary in the direct expression of a nucleotide sequence of interest but which are present due to convenient restriction sites for removal of the cassette from an expression vector. The expression cassette comprising the nucleotide sequence of interest may be chimeric, meaning that at least one of its components is heterologous with respect to at least one of its other components. The expression cassette may also be one that is naturally occurring but has been obtained in a recombinant form useful for heterologous expression. Typically, however, the expression cassette is heterologous with respect to the host, i.e., the particular nucleic acid sequence of the expression cassette does not occur naturally in the host cell and must have been introduced into the host cell or an ancestor of the host cell by a transformation process known in the art. The expression of the nucleotide sequence in the expression cassette may be under the control of a constitutive promoter or of an inducible promoter that initiates transcription only when the host cell is exposed to some particular external stimulus. In the case of a multicellular organism, such as a plant, the promoter can also be specific to a particular tissue, or organ, or stage of development. An expression cassette, or fragment thereof, can also be referred to as "inserted sequence" or "insertion sequence" when transformed into a plant.

A "gene" is a defined region that is located within a genome and that, besides the aforementioned coding nucleic acid sequence, comprises other, primarily regulatory, nucleic acid sequences responsible for the control of the expression, that is to say the transcription and translation, of the coding portion. Genes can include both coding and non-coding regions (e.g., introns, regulatory elements, promoters, enhancers, termination sequences and 5' and 3' untranslated regions). A gene typically expresses mRNA, functional RNA, or specific protein, including regulatory sequences. Genes may or may not be capable of being used to produce a functional protein. In some embodiments, a gene refers to only the coding region. The term "native gene" refers to a gene as found in nature. The term "chimeric gene" refers to any gene that contains 1) DNA sequences, including regulatory and coding sequences that are not found together in nature, or 2) sequences encoding parts of proteins not naturally adjoined, or 3) parts of promoters that are not naturally adjoined. Accordingly, a chimeric gene may comprise regulatory sequences and coding sequences that are derived from different sources, or comprise regulatory sequences and coding sequences derived from the same source, but arranged in a manner different from that found in nature. A gene may be "isolated" by which is meant a nucleic acid molecule that is substantially or essentially free from components normally found in association with the nucleic acid molecule in its natural state. Such components include other cellular material, culture medium from recombinant production, and/or various chemicals used in chemically synthesizing the nucleic acid molecule.

By the term "express" or "expression" of a polynucleotide coding sequence, it is meant that the sequence is transcribed, and optionally translated.

A "gene of interest" or "nucleotide sequence of interest" refers to any gene which, when transferred to a plant, confers upon the plant a desired characteristic such as antibiotic resistance, virus resistance, insect resistance, disease resistance, or resistance to other pests, herbicide tolerance, improved nutritional value, improved performance in an industrial process or altered reproductive capability. The "gene of interest" may also be one that is transferred to plants for the production of commercially valuable enzymes or metabolites in the plant.

As used herein, "heterologous" refers to a nucleic acid molecule or nucleotide sequence not naturally associated with a host cell into which it is introduced, that either originates from another species or is from the same species or organism but is modified from either its original form or the form primarily expressed in the cell, including non-naturally occurring multiple copies of a naturally occurring nucleic acid sequence. Thus, a nucleotide sequence derived from an organism or species different from that of the cell into which the nucleotide sequence is introduced, is heterologous with respect to that cell and the cell's descendants. In addition, a heterologous nucleotide sequence includes a nucleotide sequence derived from and inserted into the same natural, original cell type, but which is present in a non-natural state, e.g., present in a different copy number, and/or under the control of different regulatory sequences than that found in the native state of the nucleic acid molecule. A nucleic acid sequence can also be heterologous to other nucleic acid sequences with which it may be associated, for example in a nucleic acid construct, such as e.g., an expression vector. As one non-limiting example, a promoter may be present in a nucleic acid construct in combination with one or more regulatory element and/or coding sequences that do not naturally occur in association with that particular promoter, i.e., they are heterologous to the promoter.

A "homologous" nucleic acid sequence is a nucleic acid sequence naturally associated with a host cell into which it is introduced. A homologous nucleic acid sequence can also be a nucleic acid sequence that is naturally associated with other nucleic acid sequences that may be present, e.g., in a nucleic acid construct. As one non-limiting example, a promoter may be present in a nucleic acid construct in combination with one or more regulatory elements and/or coding sequences that naturally occur in association with that particular promoter, i.e. they are homologous to the promoter.

"Operably-linked" refers to the association of nucleic acid sequences on a single nucleic acid sequence so that the function of one affects the function of the other. For example, a promoter is operably-linked with a coding sequence or functional RNA when it is capable of affecting the expression of that coding sequence or functional RNA (i.e. the coding sequence or functional RNA is under the transcriptional control of the promoter). Coding sequences in sense or antisense orientation can be operably-linked to regulatory sequences. Thus, regulatory or control sequences (e.g., promoters) operatively associated with a nucleotide sequence are capable of effecting expression of the nucleotide sequence. For example, a promoter operably linked to a nucleotide sequence encoding GFP would be capable of effecting the expression of that GFP nucleotide sequence.

The control sequences need not be contiguous with the nucleotide sequence of interest, as long as they function to direct the expression thereof. Thus, for example, intervening untranslated, yet transcribed, sequences can be present between a promoter and a coding sequence, and the promoter sequence can still be considered "operably linked" to the coding sequence.

"Primers" as used herein are isolated nucleic acids that are annealed to a complementary target DNA strand by nucleic acid hybridization to form a hybrid between the primer and the target DNA strand, then extended along the target DNA strand by a polymerase, such as DNA polymerase. Primer pairs or sets can be used for amplification of a nucleic acid molecule, for example, by the polymerase chain reaction (PCR) or other nucleic-acid amplification methods.

A "probe" is an isolated nucleic acid molecule that is complementary to a portion of a target nucleic acid molecule and is typically used to detect and/or quantify the target nucleic acid molecule. Thus, in some embodiments, a probe can be an isolated nucleic acid molecule to which is attached a detectable moiety or reporter molecule, such as a radioactive isotope, ligand, chemiluminescence agent, fluorescence agent or enzyme. Probes according to the present invention can include not only deoxyribonucleic or ribonucleic acids but also polyamides and other probe materials that bind specifically to a target nucleic acid sequence and can be used to detect the presence of and/or quantify the amount of, that target nucleic acid sequence.

A TaqMan probe is designed such that it anneals within a DNA region amplified by a specific set of primers. As the Taq polymerase extends the primer and synthesizes the nascent strand from a single-strand template from 3' to 5' of the complementary strand, the 5' to 3' exonuclease of the polymerase extends the nascent strand through the probe and consequently degrades the probe that has annealed to the template. Degradation of the probe releases the fluorophore from it and breaks the close proximity to the quencher, thus relieving the quenching effect and allowing fluorescence of the fluorophore. Hence, fluorescence detected in the quantitative PCR thermal cycler is directly proportional to the fluorophore released and the amount of DNA template present in the PCR.

Primers and probes are generally between 5 and 100 nucleotides or more in length. In some embodiments, primers and probes can be at least 20 nucleotides or more in length, or at least 25 nucleotides or more, or at least 30 nucleotides or more in length. Such primers and probes hybridize specifically to a target sequence under optimum hybridization conditions as are known in the art. Primers and probes according to the present invention may have complete sequence complementarity with the target sequence, although probes differing from the target sequence and which retain the ability to hybridize to target sequences may be designed by conventional methods according to the invention.

Methods for preparing and using probes and primers are described, for example, in *Molecular Cloning: A Laboratory Manual*, 2nd ed., vol. 1-3, ed. Sambrook et al., Cold Spring Harbor Laboratory Press, Cold Spring Harbor, N.Y., 1989. PCR-primer pairs can be derived from a known sequence, for example, by using computer programs intended for that purpose.

The polymerase chain reaction (PCR) is a technique for "amplifying" a particular piece of DNA. In order to perform PCR, at least a portion of the nucleotide sequence of the DNA molecule to be replicated must be known. In general, primers or short oligonucleotides are used that are comple- mentary (e.g., substantially complementary or fully comple- mentary) to the nucleotide sequence at the 3' end of each strand of the DNA to be amplified (known sequence). The DNA sample is heated to separate its strands and is mixed with the primers. The primers hybridize to their comple- mentary sequences in the DNA sample. Synthesis begins (5' to 3' direction) using the original DNA strand as the tem- plate. The reaction mixture must contain all four deoxy- nucleotide triphosphates (dATP, dCTP, dGTP and dTTP) and a DNA polymerase.

Polymerization continues until each newly-synthesized strand has proceeded far enough to contain the sequence recognized by the other primer. Once this occurs, two DNA molecules are created that are identical to the original molecule. These two molecules are heated to separate their strands and the process is repeated. Each cycle doubles the number of DNA molecules. Using automated equipment, each cycle of replication can be completed in less than 5 minutes. After 30 cycles, what began as a single molecule of DNA has been amplified into more than a billion copies ($2^{30}=1.02\times10^9$).

The oligonucleotides of an oligonucleotide primer pair are complementary to DNA sequences located on opposite DNA strands and flanking the region to be amplified. The annealed primers hybridize to the newly synthesized DNA strands. The first amplification cycle will result in two new DNA strands whose 5' end is fixed by the position of the oligo- nucleotide primer but whose 3' end is variable ('ragged' 3' ends). The two new strands can serve in turn as templates for synthesis of complementary strands of the desired length (the 5' ends are defined by the primer and the 3' ends are fixed because synthesis cannot proceed past the terminus of the opposing primer). After a few cycles, the desired fixed length product begins to predominate.

A quantitative polymerase chain reaction (qPCR), also referred to as real-time polymerase chain reaction, monitors the accumulation of a DNA product from a PCR reaction in real time. qPCR is a laboratory technique of molecular biology based on the polymerase chain reaction (PCR), which is used to amplify and simultaneously quantify a targeted DNA molecule. Even one copy of a specific sequence can be amplified and detected in PCR. The PCR reaction generates copies of a DNA template exponentially. This results in a quantitative relationship between the amount of starting target sequence and amount of PCR product accumulated at any particular cycle. Due to inhibi- tors of the polymerase reaction found with the template, reagent limitation or accumulation of pyrophosphate mol- ecules, the PCR reaction eventually ceases to generate template at an exponential rate (i.e., the plateau phase), making the end point quantitation of PCR products unreli- able. Therefore, duplicate reactions may generate variable amounts of PCR product. Only during the exponential phase of the PCR reaction is it possible to extrapolate back in order to determine the starting quantity of template sequence. The measurement of PCR products as they accumulate (i.e., real-time quantitative PCR) allows quantitation in the expo- nential phase of the reaction and therefore removes the variability associated with conventional PCR. In a real time PCR assay, a positive reaction is detected by accumulation of a fluorescent signal. For one or more specific sequences in a DNA sample, quantitative PCR enables both detection and quantification. The quantity can be either an absolute number of copies or a relative amount when normalized to DNA input or additional normalizing genes. Since the first documentation of real-time PCR, it has been used for an increasing and diverse number of applications including mRNA expression studies, DNA copy number measure- ments in genomic or viral DNAs, allelic discrimination assays, expression analysis of specific splice variants of genes and gene expression in paraffin-embedded tissues and laser captured micro-dissected cells.

As used herein, the phrase "Ct value" refers to "threshold cycle," which is defined as the "fractional cycle number at which the amount of amplified target reaches a fixed thresh- old." In some embodiments, it represents an intersection between an amplification curve and a threshold line. The amplification curve is typically in an "S" shape indicating the change of relative fluorescence of each reaction (Y-axis) at a given cycle (X-axis), which in some embodiments is recorded during PCR by a real-time PCR instrument. The threshold line is in some embodiments the level of detection at which a reaction reaches a fluorescence intensity above background. See Livak & Schmittgen (2001) 25 *Methods* 402-408. It is a relative measure of the concentration of the target in the PCR. Generally, good Ct values for quantitative assays such as qPCR are in some embodiments in the range of 10-40 for a given reference gene. Ct levels are inversely proportional to the amount of target nucleic acid in the sample (i.e. the lower the Ct level the greater the amount of detectable target nucleic acid in the sample). Additionally, good Ct values for quantitative assays such as qPCR show a linear response range with proportional dilutions of target gDNA.

In some embodiments, qPCR is performed under condi- tions wherein the Ct value can be collected in real-time for quantitative analysis. For example, in a typical qPCR experi- ment, DNA amplification is monitored at each cycle of PCR during the extension stage. The amount of fluorescence generally increases above the background when DNA is in the log linear phase of amplification. In some embodiments, the Ct value is collected at this time point.

As used herein, the term "cell" refers to any living cell. The cell may be a prokaryotic or eukaryotic cell. The cell may be isolated. The cell may or may not be capable of regenerating into an organism. The cell may be in the context of a tissue, callus, culture, organ, or part. In some embodiments, the cell may be a plant cell. A plant cell of the present invention can be in the form of an isolated single cell or can be a cultured cell or can be a part of a higher- organized unit such as, for example, a plant tissue or a plant organ. The plant cell may be derived from or part of an angiosperm or gymnosperm. In further embodiments, the plant cell may be a monocotyledonous plant cell, a dicoty- ledonous plant cell. The monocotyledonous plant cell may be, for example, a maize, rice, sorghum, sugarcane, barley, wheat, oat, turf grass, or ornamental grass cell. The dicoty- ledonous plant cell may be, for example, a tobacco, pepper, eggplant, sunflower, crucifer, flax, potato, cotton, soybean, sugar bee, or oilseed rape cell.

The term "plant part," as used herein, includes but is not limited to embryos, pollen, ovules, seeds, leaves, stems, shoots, flowers, branches, fruit, kernels, ears, cobs, husks, stalks, roots, root tips, anthers, plant cells including plant cells that are intact in plants and/or parts of plants, plant protoplasts, plant tissues, plant cell tissue cultures, plant calli, plant clumps, and the like. As used herein, "shoot" refers to the above ground parts including the leaves and stems. Further, as used herein, "plant cell" refers to a structural and physiological unit of the plant, which comprises a cell wall and also may refer to a protoplast.

The term "introducing" or "introduce" in the context of a cell, prokaryotic cell, bacterial cell, eukaryotic cell, plant cell, plant and/or plant part means contacting a nucleic acid molecule with the cell, eukaryotic cell, plant, plant part, and/or plant cell in such a manner that the nucleic acid molecule gains access to the interior of the cell, eukaryotic cell, plant cell and/or a cell of the plant and/or plant part. Where more than one nucleic acid molecule is to be introduced these nucleic acid molecules can be assembled as part of a single polynucleotide or nucleic acid construct, or as separate polynucleotide or nucleic acid constructs, and can be located on the same or different nucleic acid constructs. Accordingly, these polynucleotides can be introduced into plant cells in a single transformation event, in separate transformation events, or, e.g., as part of a breeding protocol.

As used herein, the terms "transformed" and "transgenic" refer to any cell, prokaryotic cell, eukaryotic cell, plant, plant cell, callus, plant tissue, or plant part that contains all or part of at least one recombinant (e.g., heterologous) polynucleotide. In some embodiments, all or part of the recombinant polynucleotide is stably integrated into a chromosome or stable extrachromosomal element, so that it is passed on to successive generations. For the purposes of the invention, the term "recombinant polynucleotide" refers to a polynucleotide that has been altered, rearranged, or modified by genetic engineering. Examples include any cloned polynucleotide, or polynucleotides, that are linked or joined to heterologous sequences. The term "recombinant" does not refer to alterations of polynucleotides that result from naturally occurring events, such as spontaneous mutations, or from non-spontaneous mutagenesis followed by selective breeding.

The term "transformation" as used herein refers to the introduction of a heterologous nucleic acid into a cell. Transformation of a cell may be stable or transient. Thus, a transgenic cell, plant cell, plant and/or plant part of the invention can be stably transformed or transiently transformed. Transformation can refer to the transfer of a nucleic acid molecule into the genome of a host cell, resulting in genetically stable inheritance. In some embodiments, the introduction into a plant, plant part and/or plant cell is via bacterial-mediated transformation, particle bombardment transformation, calcium-phosphate-mediated transformation, cyclodextrin-mediated transformation, electroporation, liposome-mediated transformation, nanoparticle-mediated transformation, polymer-mediated transformation, virus-mediated nucleic acid delivery, whisker-mediated nucleic acid delivery, microinjection, sonication, infiltration, polyethylene glycol-mediated transformation, protoplast transformation, or any other electrical, chemical, physical and/or biological mechanism that results in the introduction of nucleic acid into the plant, plant part and/or cell thereof, or any combination thereof.

Procedures for transforming plants are well known and routine in the art and are described throughout the literature. Non-limiting examples of methods for transformation of plants include transformation via bacterial-mediated nucleic acid delivery (e.g. via bacteria from the genus *Agrobacterium*), viral-mediated nucleic acid delivery, silicon carbide or nucleic acid whisker-mediated nucleic acid delivery, liposome mediated nucleic acid delivery, microinjection, microparticle bombardment, calcium-phosphate-mediated transformation, cyclodextrin-mediated transformation, electroporation, nanoparticle-mediated transformation, sonication, infiltration, PEG-mediated nucleic acid uptake, as well as any other electrical, chemical, physical (mechanical) and/or biological mechanism that results in the introduction of nucleic acid into the plant cell, including any combination thereof. General guides to various plant transformation methods known in the art include Miki et al. ("Procedures for Introducing Foreign DNA into Plants" in Methods in *Plant Molecular Biology and Biotechnology*, Glick, B. R. and Thompson, J. E., Eds. (CRC Press, Inc., Boca Raton, 1993), pages 67-88) and Rakowoczy-Trojanowska (*Cell Mol Biol Lett* 7:849-858 (2002)).

*Agrobacterium*-mediated transformation is a commonly used method for transforming plants because of its high efficiency of transformation and because of its broad utility with many different species. *Agrobacterium*-mediated transformation typically involves transfer of the binary vector carrying the foreign DNA of interest to an appropriate *Agrobacterium* strain that may depend on the complement of vir genes carried by the host *Agrobacterium* strain either on a co-resident Ti plasmid or chromosomally (Uknes et al. 1993, *Plant Cell* 5:159-169). The transfer of the recombinant binary vector to *Agrobacterium* can be accomplished by a tri-parental mating procedure using *Escherichia coli* carrying the recombinant binary vector, a helper *E. coli* strain that carries a plasmid that is able to mobilize the recombinant binary vector to the target *Agrobacterium* strain. Alternatively, the recombinant binary vector can be transferred to *Agrobacterium* by nucleic acid transformation (Hagen and Willmitzer 1988, *Nucleic Acids Res* 16:9877).

Transformation of a plant by recombinant *Agrobacterium* usually involves co-cultivation of the *Agrobacterium* with explants from the plant and follows methods well known in the art. Transformed tissue is typically regenerated on selection medium carrying an antibiotic or herbicide resistance marker between the binary plasmid T-DNA borders.

Another method for transforming plants, plant parts and plant cells involves propelling inert or biologically active particles at plant tissues and cells. See, e.g., U.S. Pat. Nos. 4,945,050; 5,036,006 and 5,100,792. Generally, this method involves propelling inert or biologically active particles at the plant cells under conditions effective to penetrate the outer surface of the cell and afford incorporation within the interior thereof. When inert particles are utilized, the vector can be introduced into the cell by coating the particles with the vector containing the nucleic acid of interest. Alternatively, a cell or cells can be surrounded by the vector so that the vector is carried into the cell by the wake of the particle. Biologically active particles (e.g., dried yeast cells, dried bacteria or a bacteriophage, each containing one or more nucleic acids sought to be introduced) also can be propelled into plant tissue.

"Transient transformation" in the context of a polynucleotide means that a polynucleotide is introduced into the cell and does not integrate into the genome of the cell.

As used herein, "stably introducing," "stably introduced," "stable transformation" or "stably transformed" in the context of a polynucleotide introduced into a cell, means that the introduced polynucleotide is stably integrated into the genome of the cell, and thus the cell is stably transformed with the polynucleotide. As such, the integrated polynucleotide is capable of being inherited by the progeny thereof, more particularly, by the progeny of multiple successive generations. "Genome" as used herein includes the nuclear and/or plastid genome, and therefore includes integration of a polynucleotide into, for example, the chloroplast genome. Stable transformation as used herein can also refer to a polynucleotide that is maintained extrachromosomally, for example, as a minichromosome.

Transient transformation may be detected by, for example, an enzyme-linked immunosorbent assay (ELISA) or Western blot, which can detect the presence of a peptide or polypeptide encoded by one or more nucleic acid molecules introduced into an organism. Stable transformation of a cell can be detected by, for example, a Southern blot hybridization assay of genomic DNA of the cell with nucleic acid sequences which specifically hybridize with a nucleotide sequence of a nucleic acid molecule introduced into an organism (e.g., a plant). Stable transformation of a cell can be detected by, for example, a Northern blot hybridization assay of RNA of the cell with nucleic acid sequences which specifically hybridize with a nucleotide sequence of a nucleic acid molecule introduced into a plant or other organism. Stable transformation of a cell can also be detected by, e.g., a polymerase chain reaction (PCR) or other amplification reaction as are well known in the art, employing specific primer sequences that hybridize with target sequence(s) of a nucleic acid molecule, resulting in amplification of the target sequence(s), which can be detected according to standard methods. Transformation can also be detected by direct sequencing and/or hybridization protocols well known in the art.

Thus, in particular embodiments of the present invention, a plant cell can be transformed by any method known in the art and as described herein and intact plants can be regenerated from these transformed cells using any of a variety of known techniques. Plant regeneration from plant cells, plant tissue culture and/or cultured protoplasts is described, for example, in Evans et al. (*Handbook of Plant Cell Cultures*, Vol. 1, MacMilan Publishing Co. New York (1983)); and Vasil I. R. (ed.) (*Cell Culture and Somatic Cell Genetics of Plants*, Acad. Press, Orlando, Vol. I (1984), and Vol. II (1986)). Methods of selecting for transformed transgenic plants, plant cells and/or plant tissue culture are routine in the art and can be employed in the methods of the invention provided herein.

The "transformation and regeneration process" refers to the process of stably introducing a transgene into a plant cell and regenerating a plant from the transgenic plant cell. As used herein, transformation and regeneration includes the selection process, whereby a transgene comprises a selectable marker and the transformed cell has incorporated and expressed the transgene, such that the transformed cell will survive and developmentally flourish in the presence of the selection agent. "Regeneration" refers to growing a whole plant from a plant cell, a group of plant cells, or a plant piece such as from a protoplast, callus, or tissue part.

The terms "nucleotide sequence" "nucleic acid," "nucleic acid sequence," "nucleic acid molecule," "oligonucleotide" and "polynucleotide" are used interchangeably herein to refer to a heteropolymer of nucleotides and encompass both RNA and DNA, including cDNA, genomic DNA, mRNA, synthetic (e.g., chemically synthesized) DNA or RNA and chimeras of RNA and DNA. The term nucleic acid molecule refers to a chain of nucleotides without regard to length of the chain. The nucleotides contain a sugar, phosphate and a base which is either a purine or pyrimidine. A nucleic acid molecule can be double-stranded or single-stranded. Where single-stranded, the nucleic acid molecule can be a sense strand or an antisense strand. A nucleic acid molecule can be synthesized using oligonucleotide analogs or derivatives (e.g., inosine or phosphorothioate nucleotides). Such oligonucleotides can be used, for example, to prepare nucleic acid molecules that have altered base-pairing abilities or increased resistance to nucleases. Nucleic acid sequences provided herein are presented herein in the 5' to 3' direction, from left to right and are represented using the standard code for representing the nucleotide characters as set forth in the U.S. sequence rules, 37 CFR §§ 1.821-1.825 and the World Intellectual Property Organization (WIPO) Standard ST.25.

A "nucleic acid fragment" is a fraction of a given nucleic acid molecule. An "RNA fragment" is a fraction of a given RNA molecule. A "DNA fragment" is a fraction of a given DNA molecule. A "nucleic acid segment" is a fraction of a given nucleic acid molecule and is not isolated from the molecule. An "RNA segment" is a fraction of a given RNA molecule and is not isolated from the molecule. A "DNA segment" is a fraction of a given DNA molecule and is not isolated from the molecule. Segments of polynucleotides can be any length, for example, at least 5, 10, 15, 20, 25, 30, 40, 50, 75, 100, 150, 200, 300 or 500 or more nucleotides in length. A segment or portion of a guide sequence can be about 50%, 40%, 30%, 20%, 10% of the guide sequence, e.g., one-third of the guide sequence or shorter, e.g., 7, 6, 5, 4, 3, or 2 nucleotides in length.

The term "derived from" in the context of a molecule refers to a molecule isolated or made using a parent molecule or information from that parent molecule. For example, a Cas9 single mutant nickase and a Cas9 double mutant null-nuclease are derived from a wild-type Cas9 protein.

In higher plants, deoxyribonucleic acid (DNA) is the genetic material while ribonucleic acid (RNA) is involved in the transfer of information contained within DNA into proteins. A "genome" is the entire body of genetic material contained in each cell of an organism. Unless otherwise indicated, a particular nucleic acid sequence of this invention also implicitly encompasses conservatively modified variants thereof (e.g., degenerate codon substitutions) and complementary sequences and as well as the sequence explicitly indicated. Specifically, degenerate codon substitutions may be achieved by generating sequences in which the third position of one or more selected (or all) codons is substituted with mixed-base and/or deoxyinosine residues (Batzer et al., *Nucleic Acid Res.* 19:5081 (1991); Ohtsuka et al., *J. Biol. Chem.* 260:2605-2608 (1985); and Rossolini et al., *Mol. Cell. Probes* 8:91-98 (1994)). The term nucleic acid molecule is used interchangeably with gene, cDNA, and mRNA encoded by a gene.

As used herein "sequence identity" refers to the extent to which two optimally aligned polynucleotide or peptide sequences are invariant throughout a window of alignment of components, e.g., nucleotides or amino acids. "Identity" can be readily calculated by known methods including, but not limited to, those described in: *Computational Molecular Biology* (Lesk, A. M., ed.) Oxford University Press, New York (1988); *Biocomputing: Informatics and Genome Projects* (Smith, D. W., ed.) Academic Press, New York (1993); *Computer Analysis of Sequence Data, Part I* (Griffin, A. M., and Griffin, H. G., eds.) Humana Press, New Jersey (1994); *Sequence Analysis in Molecular Biology* (von Heinje, G., ed.) Academic Press (1987); and *Sequence Analysis Primer* (Gribskov, M. and Devereux, J., eds.) Stockton Press, New York (1991).

As used herein, the term "percent sequence identity" or "percent identity" refers to the percentage of identical nucleotides in a linear polynucleotide sequence of a reference ("query") polynucleotide molecule (or its complementary strand) as compared to a test ("subject") polynucleotide molecule (or its complementary strand) when the two sequences are optimally aligned. In some embodiments, "percent identity" can refer to the percentage of identical amino acids in an amino acid sequence.

As used herein, the phrase "substantially identical," in the context of two nucleic acid molecules, nucleotide sequences or protein sequences, refers to two or more sequences or subsequences that have at least about 70%, least about 75%, at least about 80%, at least about 85%, at least about 90%, at least about 95%, at least about 96%, at least about 97%, at least about 98%, or at least about 99% nucleotide or amino acid residue identity, when compared and aligned for maximum correspondence, as measured using one of the following sequence comparison algorithms or by visual inspection. In some embodiments of the invention, the substantial identity exists over a region of the sequences that is at least about 50 residues to about 150 residues in length. Thus, in some embodiments of this invention, the substantial identity exists over a region of the sequences that is at least about 50, about 60, about 70, about 80, about 90, about 100, about 110, about 120, about 130, about 140, about 150, or more residues in length. In some particular embodiments, the sequences are substantially identical over at least about 150 residues. In a further embodiment, the sequences are substantially identical over the entire length of the coding regions. Furthermore, in representative embodiments, substantially identical nucleotide or protein sequences perform substantially the same function (e.g., guiding to a particular genomic target, endonuclease cleavage of a particular genomic target site).

For sequence comparison, typically one sequence acts as a reference sequence to which test sequences are compared. When using a sequence comparison algorithm, test and reference sequences are entered into a computer, subsequence coordinates are designated if necessary, and sequence algorithm program parameters are designated. The sequence comparison algorithm then calculates the percent sequence identity for the test sequence(s) relative to the reference sequence, based on the designated program parameters.

Optimal alignment of sequences for aligning a comparison window are well known to those skilled in the art and may be conducted by tools such as the local homology algorithm of Smith and Waterman, the homology alignment algorithm of Needleman and Wunsch, the search for similarity method of Pearson and Lipman, and optionally by computerized implementations of these algorithms such as GAP, BESTFIT, FASTA, and TFASTA available as part of the GCG® Wisconsin Package® (Accelrys Inc., San Diego, CA). An "identity fraction" for aligned segments of a test sequence and a reference sequence is the number of identical components which are shared by the two aligned sequences divided by the total number of components in the reference sequence segment, i.e., the entire reference sequence or a smaller defined part of the reference sequence. Percent sequence identity is represented as the identity fraction multiplied by 100. The comparison of one or more polynucleotide sequences may be to a full-length polynucleotide sequence or a portion thereof, or to a longer polynucleotide sequence. For purposes of this invention "percent identity" may also be determined using BLASTX version 2.0 for translated nucleotide sequences and BLASTN version 2.0 for polynucleotide sequences.

Software for performing BLAST analyses is publicly available through the National Center for Biotechnology Information. This algorithm involves first identifying high scoring sequence pairs (HSPs) by identifying short words of length W in the query sequence, which either match or satisfy some positive-valued threshold score T when aligned with a word of the same length in a database sequence. T is referred to as the neighborhood word score threshold (Altschul et al., 1990). These initial neighborhood word hits act as seeds for initiating searches to find longer HSPs containing them. The word hits are then extended in both directions along each sequence for as far as the cumulative alignment score can be increased. Cumulative scores are calculated using, for nucleotide sequences, the parameters M (reward score for a pair of matching residues; always >0) and N (penalty score for mismatching residues; always <0). For amino acid sequences, a scoring matrix is used to calculate the cumulative score. Extension of the word hits in each direction are halted when the cumulative alignment score falls off by the quantity X from its maximum achieved value, the cumulative score goes to zero or below due to the accumulation of one or more negative-scoring residue alignments, or the end of either sequence is reached. The BLAST algorithm parameters W, T, and X determine the sensitivity and speed of the alignment. The BLASTN program (for nucleotide sequences) uses as defaults a wordlength (W) of 11, an expectation (E) of 10, a cutoff of 100, M=5, N=−4, and a comparison of both strands. For amino acid sequences, the BLASTP program uses as defaults a wordlength (W) of 3, an expectation (E) of 10, and the BLOSUM62 scoring matrix (see Henikoff & Henikoff, *Proc. Natl. Acad. Sci. USA* 89: 10915 (1989)).

In addition to calculating percent sequence identity, the BLAST algorithm also performs a statistical analysis of the similarity between two sequences (see, e.g., Karlin & Altschul, *Proc. Nat'l. Acad. Sci. USA* 90: 5873-5787 (1993)). One measure of similarity provided by the BLAST algorithm is the smallest sum probability (P(N)), which provides an indication of the probability by which a match between two nucleotide or amino acid sequences would occur by chance. For example, a test nucleic acid sequence is considered similar to a reference sequence if the smallest sum probability in a comparison of the test nucleotide sequence to the reference nucleotide sequence is less than about 0.1 to less than about 0.001. Thus, in some embodiments of the invention, the smallest sum probability in a comparison of the test nucleotide sequence to the reference nucleotide sequence is less than about 0.001.

Two nucleotide sequences can also be considered substantially identical when the two sequences hybridize to each other under stringent conditions. In some representative embodiments, two nucleotide sequences considered to be substantially identical hybridize to each other under highly stringent conditions.

"Stringent hybridization conditions" and "stringent hybridization wash conditions" in the context of nucleic acid hybridization experiments such as Southern and Northern hybridizations are sequence dependent, and are different under different environmental parameters. An extensive guide to the hybridization of nucleic acids is found in Tijssen *Laboratory Techniques in Biochemistry and Molecular Biology-Hybridization with Nucleic Acid Probes* part I chapter 2 "Overview of principles of hybridization and the strategy of nucleic acid probe assays" Elsevier, New York (1993). Generally, highly stringent hybridization and wash conditions are selected to be about 5° C. lower than the thermal melting point ($T_m$) for the specific sequence at a defined ionic strength and pH.

The $T_m$ is the temperature (under defined ionic strength and pH) at which 50% of the target sequence hybridizes to a perfectly matched probe. Very stringent conditions are selected to be equal to the $T_m$ for a particular probe. An example of stringent hybridization conditions for hybridization of complementary nucleotide sequences which have more than 100 complementary residues on a filter in a Southern or northern blot is 50% formamide with 1 mg of heparin at 42° C., with the hybridization being carried out overnight. An example of highly stringent wash conditions is 0.1 5M NaCl at 72° C. for about 15 minutes. An example of stringent wash conditions is a 0.2×SSC wash at 65° C. for 15 minutes (see, Sambrook, infra, for a description of SSC buffer). Often, a high stringency wash is preceded by a low stringency wash to remove background probe signal. An example of a medium stringency wash for a duplex of, e.g., more than 100 nucleotides, is 1×SSC at 45° C. for 15 minutes. An example of a low stringency wash for a duplex of, e.g., more than 100 nucleotides, is 4-6×SSC at 40° C. for 15 minutes. For short probes (e.g., about 10 to 50 nucleotides), stringent conditions typically involve salt concentrations of less than about 1.0 M Na ion, typically about 0.01 to 1.0 M Na ion concentration (or other salts) at pH 7.0 to 8.3, and the temperature is typically at least about 30° C. Stringent conditions can also be achieved with the addition of destabilizing agents such as formamide. In general, a signal to noise ratio of 2× (or higher) than that observed for an unrelated probe in the particular hybridization assay indicates detection of a specific hybridization. Nucleotide sequences that do not hybridize to each other under stringent conditions are still substantially identical if the proteins that they encode are substantially identical. This can occur, for example, when a copy of a nucleotide sequence is created using the maximum codon degeneracy permitted by the genetic code.

The following are examples of sets of hybridization/wash conditions that may be used to clone homologous nucleotide sequences that are substantially identical to reference nucleotide sequences of the present invention. In one embodiment, a reference nucleotide sequence hybridizes to the "test" nucleotide sequence in 7% sodium dodecyl sulfate (SDS), 0.5 M NaPO$_4$, 1 mM EDTA at 50° C. with washing in 2×SSC, 0.1% SDS at 50° C. In another embodiment, the reference nucleotide sequence hybridizes to the "test" nucleotide sequence in 7% sodium dodecyl sulfate (SDS), 0.5 M NaPO$_4$, 1 mM EDTA at 50° C. with washing in 1×SSC, 0.1% SDS at 50° C. or in 7% sodium dodecyl sulfate (SDS), 0.5 M NaPO$_4$, 1 mM EDTA at 50° C. with washing in 0.5×SSC, 0.1% SDS at 50° C. In still further embodiments, the reference nucleotide sequence hybridizes to the "test" nucleotide sequence in 7% sodium dodecyl sulfate (SDS), 0.5 M NaPO$_4$, 1 mM EDTA at 50° C. with washing in 0.1×SSC, 0.1% SDS at 50° C., or in 7% sodium dodecyl sulfate (SDS), 0.5 M NaPO$_4$, 1 mM EDTA at 50° C. with washing in 0.1×SSC, 0.1% SDS at 65° C.

An "isolated" nucleic acid molecule or nucleotide sequence or an "isolated" polypeptide is a nucleic acid molecule, nucleotide sequence or polypeptide that, by the hand of man, exists apart from its native environment and/or has a function that is different, modified, modulated and/or altered as compared to its function in its native environment and is therefore not a product of nature. An isolated nucleic acid molecule or isolated polypeptide may exist in a purified form or may exist in a non-native environment such as, for example, a recombinant host cell. Thus, for example, with respect to polynucleotides, the term isolated means that it is separated from the chromosome and/or cell in which it naturally occurs. A polynucleotide is also isolated if it is separated from the chromosome and/or cell in which it naturally occurs and is then inserted into a genetic context, a chromosome, a chromosome location, and/or a cell in which it does not naturally occur. The recombinant nucleic acid molecules and nucleotide sequences of the invention can be considered to be "isolated" as defined above.

Thus, an "isolated nucleic acid molecule" or "isolated nucleotide sequence" is a nucleic acid molecule or nucleotide sequence that is not immediately contiguous with nucleotide sequences with which it is immediately contiguous (one on the 5' end and one on the 3' end) in the naturally occurring genome of the organism from which it is derived. Accordingly, in one embodiment, an isolated nucleic acid includes some or all of the 5' non-coding (e.g., promoter) sequences that are immediately contiguous to a coding sequence. The term therefore includes, for example, a recombinant nucleic acid that is incorporated into a vector, into an autonomously replicating plasmid or virus, or into the genomic DNA of a prokaryote or eukaryote, or which exists as a separate molecule (e.g., a cDNA or a genomic DNA fragment produced by PCR or restriction endonuclease treatment), independent of other sequences. It also includes a recombinant nucleic acid that is part of a hybrid nucleic acid molecule encoding an additional polypeptide or peptide sequence. An "isolated nucleic acid molecule" or "isolated nucleotide sequence" can also include a nucleotide sequence derived from and inserted into the same natural, original cell type, but which is present in a non-natural state, e.g., present in a different copy number, and/or under the control of different regulatory sequences than that found in the native state of the nucleic acid molecule.

The term "isolated" can further refer to a nucleic acid molecule, nucleotide sequence, polypeptide, peptide or fragment that is substantially free of cellular material, viral material, and/or culture medium (e.g., when produced by recombinant DNA techniques), or chemical precursors or other chemicals (e.g., when chemically synthesized). Moreover, an "isolated fragment" is a fragment of a nucleic acid molecule, nucleotide sequence or polypeptide that is not naturally occurring as a fragment and would not be found as such in the natural state. "Isolated" does not necessarily mean that the preparation is technically pure (homogeneous), but it is sufficiently pure to provide the polypeptide or nucleic acid in a form in which it can be used for the intended purpose.

In representative embodiments of the invention, an "isolated" nucleic acid molecule, nucleotide sequence, and/or polypeptide is at least about 5%, 10%, 15%, 20%, 25%, 30%, 40%, 50%, 60%, 70%, 75%, 80%, 85%, 90%, 95%, 97%, 98%, 99% pure (w/w) or more. In other embodiments, an "isolated" nucleic acid, nucleotide sequence, and/or polypeptide indicates that at least about a 5-fold, 10-fold, 25-fold, 100-fold, 1000-fold, 10,000-fold, 100,000-fold or more enrichment of the nucleic acid (w/w) is achieved as compared with the starting material.

"Wild-type" nucleotide sequence or amino acid sequence refers to a naturally occurring ("native") or endogenous nucleotide sequence or amino acid sequence. Thus, for example, a "wild-type mRNA" is an mRNA that is naturally occurring in or endogenous to the organism. A "homologous" nucleotide sequence is a nucleotide sequence naturally associated with a host cell into which it is introduced.

The terms "open reading frame" and "ORF" refer to the amino acid sequence encoded between translation initiation and termination codons of a coding sequence. The terms "initiation codon" and "termination codon" refer to a unit of three adjacent nucleotides ('codon') in a coding sequence that specifies initiation and chain termination, respectively, of protein synthesis (mRNA translation).

"Promoter" refers to a nucleotide sequence, usually upstream (5') to its coding sequence, which controls the expression of the coding sequence by providing the recognition for RNA polymerase and other factors required for proper transcription. "Promoter regulatory sequences" consist of proximal and more distal upstream elements. Promoter regulatory sequences influence the transcription, RNA processing or stability, or translation of the associated coding sequence. Regulatory sequences include enhancers, promoters, untranslated leader sequences, introns, and polyadenylation signal sequences. They include natural and synthetic sequences as well as sequences that may be a combination of synthetic and natural sequences. An "enhancer" is a DNA sequence that can stimulate promoter activity and may be an innate element of the promoter or a heterologous element inserted to enhance the level or tissue specificity of a promoter. It is capable of operating in both orientations (normal or flipped), and is capable of functioning even when moved either upstream or downstream from the promoter. The meaning of the term "promoter" includes "promoter regulatory sequences."

"Primary transformant" and "TO generation" refer to transgenic plants that are of the same genetic generation as the tissue that was initially transformed (i.e., not having gone through meiosis and fertilization since transformation). "Secondary transformants" and the "T1, T2, T3, etc. generations" refer to transgenic plants derived from primary transformants through one or more meiotic and fertilization cycles. They may be derived by self-fertilization of primary or secondary transformants or crosses of primary or secondary transformants with other transformed or untransformed plants.

A "transgene" refers to a nucleic acid molecule that has been introduced into the genome by transformation and is stably maintained. A transgene may comprise at least one expression cassette, typically comprises at least two expression cassettes, and may comprise ten or more expression cassettes. Transgenes may include, for example, genes that are either heterologous or homologous to the genes of a particular plant to be transformed. Additionally, transgenes may comprise native genes inserted into a non-native organism, or chimeric genes. The term "endogenous gene" refers to a native gene in its natural location in the genome of an organism. A "foreign" gene refers to a gene not normally found in the host organism but one that is introduced into the organism by gene transfer.

"Intron" refers to an intervening section of DNA which occurs almost exclusively within a eukaryotic gene, but which is not translated to amino acid sequences in the gene product. The introns are removed from the pre-mature mRNA through a process called splicing, which leaves the exons untouched, to form an mRNA. For purposes of the present invention, the definition of the term "intron" includes modifications to the nucleotide sequence of an intron derived from a target gene, provided the modified intron does not significantly reduce the activity of its associated 5' regulatory sequence.

"Exon" refers to a section of DNA which carries the coding sequence for a protein or part of it. Exons are separated by intervening, non-coding sequences (introns). For purposes of the present invention, the definition of the term "exon" includes modifications to the nucleotide sequence of an exon derived from a target gene, provided the modified exon does not significantly reduce the activity of its associated 5' regulatory sequence.

The term "cleavage" or "cleaving" refers to breaking of the covalent phosphodiester linkage in the ribosylphosphodiester backbone of a polynucleotide. The terms "cleavage" or "cleaving" encompass both single-stranded breaks and double-stranded breaks. Double-stranded cleavage can occur as a result of two distinct single-stranded cleavage events. Cleavage can result in the production of either blunt ends or staggered ends. A "nuclease cleavage site" or "genomic nuclease cleavage site" is a region of nucleotides that comprise a nuclease cleavage sequence that is recognized by a specific nuclease, which acts to cleave the nucleotide sequence of the genomic DNA in one or both strands. Such cleavage by the nuclease enzyme initiates DNA repair mechanisms within the cell, which establishes an environment for homologous recombination to occur.

The present invention provides a fusion protein, with an improved linker between a deaminase domain and a site-directed DNA-binding domain which provides increased editing efficiency and reduced mutation frequency. In some embodiments of the invention, the deaminase domain is a cytidine deaminase. In other embodiments of the invention, the deaminase domain is an adenine deaminase. In some embodiments, the cytidine deaminase domain is an activation-induced cytidine deaminase ("AID"). In some embodiments of the invention the cytidine deaminase domain is an apolipoprotein B mRNA-editing complex ("APOBEC") domain). In some embodiments, the APOBEC domain is an APOBEC1 family deaminase.

"Cytidine deaminase" refers to enzymes that catalyze the irreversible hydrolytic deamination of cytidine and deoxycytidine to uridine and deoxyuridine, respectively. Cytidine deaminases maintain the cellular pyrimidine pool. A family of cytidine deaminases is APOBEC ("apolipoprotein B mRNA editing enzyme, catalytic polypeptide-like"). Members of this family are C to U editing enzymes. The N-terminal domain of APOBEC like proteins is the catalytic domain, while the C-terminal domain is a pseudocatalytic domain. More specifically, the catalytic domain is a zinc dependent cytidine deaminase domain and is important for cytidine deamination. RNA editing by APOBEC1 requires homodimerisation and this complex interacts with RNA binding proteins to form the editosome. Non-limiting examples of APOBEC proteins include APOBEC1, APOBEC2, APOBEC3A, APOBEC3B, APOBEC3C, APOBEC3D, APOBEC3F, APOBEC3G, APOBEC3H, APOBEC4, and activation-induced (cytidine) deaminase. Various mutants of the APOBEC proteins are also known that have bring about different editing characteristics for base editors. For instance, for human APOBEC3A, certain mutants (e.g., Y130F, Y132D, W104A and D131Y) even outperform the wildtype human APOBEC3A in terms of editing efficiency. Accordingly, the term APOBEC and each of its family member also encompasses variants and mutants that have certain level (e.g., 70%, 75%, 80%, 85%, 90%, 95%, 98%, 99%) of sequence identity to the corresponding wildtype APOBEC protein and retain the cytidine deaminating activity. The variants and mutants can be derived with amino acid additions, deletions and/or substitutions. Such substitutions, in some embodiments, are conservative substitutions.

"Cytosine base editors" ("CBEs") convert a C·G base pair into a T·A base pair.

"Adenine deaminase" refers to enzymes which catalyze the hydrolytic deamination of adenosine into inosine. Inosine pairs with C and therefore is read or replicated as G. An example enzyme is TadA from *E. coli*, which operates as a homodimer.

"Adenine base editors" ("ABEs") convert an A·T base pair to a G·C base pair.

*Lachnospiraceae bacterium* Cpf1 (LbCpf1) is one of many Cpf1 proteins of a large group. The terms "Cpf1" and "Cas12a" are used interchangeably throughout. Cpf1 is a Cas protein. The term "Cas protein" or "clustered regularly interspaced short palindromic repeats (CRISPR)—associated (Cas) protein" refers to RNA guided DNA endonuclease enzymes associated with CRISPR (Clustered Regularly Interspaced Short Palindromic Repeats)—an adaptive immunity system found in, e.g., *Streptococcus pyogenes*, as well as other bacteria. Cas proteins include Cas9, Cas12a, Cas12b, Cas12i, Cas12j, and others. In some embodiments of the invention, the site directed DNA binding domain is a catalytically inactive Cas12a from *Lachnospiraceae bacterium* ("dLbCas12a"). In other embodiments, the site directed DNA binding domain is catalytically active from *Lachnospiraceae bacterium* ("LbCas12a") or *Moraxella bovoculi* AAX08_00205 ("Mb2Cas12a"). In some embodiments of the invention, Cas12a proteins from *Lachnospiraceae bacterium, Acidaminococcus* sp., *Moraxella bovoculi, Thiomicrospira* sp., *Moraxella lacunata, Methanomethylophilus alvus, Butyrivibrio* sp., or *Bacteroidetesoral* sp. are provided as site directed DNA-binding domains of the fusion protein.

The fusion protein may include other fragments, such as uracil DNA glycosylase inhibitor (UGI) and nuclear localization sequences (NLS).

The "Uracil Glycosylase Inhibitor" (UGI), which can be prepared from *Bacillus subtilis* bacteriophage PBS1, is a small protein (9.5 kDa) which inhibits *E. coli* uracil-DNA glycosylase (UDG) as well as UDG from other species. Inhibition of UDG occurs by reversible protein binding with a 1:1 UGD:UGI stoichiometry. UGI is capable of dissociating UDG-DNA complexes. A non-limiting example of UGI is found in *Bacillus* phage AR9 (YP_009283008.1). In some embodiments, the UGI comprises the amino acid sequence of SEQ ID NO: 8 or has at least at least 70%, 75%, 80%, 85%, 90% or 95% sequence identity to SEQ ID NO: 8 and retains the uracil glycosylase inhibition activity.

In some embodiments, the UGI is placed at the C-terminal side of the cytidine deaminase-Cpf1 portion. In some embodiments, the fusion protein comprises at least two UGIs.

In some embodiments, at least one nuclear localization signal ("NLS") is located C-terminal to the first fragment and the second fragment (the cytidine deaminase-Cpf1 portion), e.g., between the second fragment (which includes the Cpf1) and an UGI. In some embodiments, at least two NLS are located between the second fragment and the UGI. In some embodiments, at least three NLS are located between the second fragment and the UGI. In some embodiments, at least one NLS is located N-terminal to the first fragment and the second fragment (the cytidine deaminase-Cpf1 portion).

Non-limiting example arrangements of the components in the fusion proteins include, from the N-terminus to the C-terminus, (a) NLS, cytidine deaminase, Cas12a, NLS, UGI, NLS, 2A, and UGI; (b) NLS, cytidine deaminase, Cas12a, NLS, NLS, UGI, NLS, 2A, and UGI; (c) NLS, cytidine deaminase, Cas12a, NLS, UGI, NLS, 2A, UGI, 2A, and UGI; (d) NLS, cytidine deaminase, Cas12a, NLS, UGI, NLS, 2A, UGI, 2A, UGI, 2A and UGI.

In some embodiments, a peptide linker is optionally provided between each of the fragments in the fusion protein. In some embodiments, the peptide linker has from 1 to 100 amino acid residues (or 3-20, 4-15, without limitation). In some embodiments, at least 10%, 20%, 30%, 40%, 50%, 60%, 70%, 80% or 90% of the amino acid residues of peptide linker are amino acid residues selected from the group consisting of alanine, glycine, cysteine, and serine.

The present invention also provides a nucleic acid molecule comprising a nucleic acid sequence encoding a guide RNA of the invention. The nucleic acid molecule may be a DNA or an RNA molecule. In some embodiments, the nucleic acid molecule is circularized. In other embodiments, the nucleic acid molecule is linear. In some embodiments, the nucleic acid molecule is single stranded, partially double-stranded, or double-stranded. In some embodiments, the nucleic acid molecule is complexed with at least one polypeptide. The polypeptide may have a nucleic acid recognition or nucleic acid binding domain. In some embodiments, the polypeptide is a shuttle for mediating delivery of, for example, a chimeric RNA of the invention, and optionally a nuclease. In some embodiments, the polypeptide is a Feldan Shuttle (U.S. Patent Publication No. 20160298078, herein incorporated by reference).

An "on-target edit" is a cytosine to thymine substitution in the region following a PAM site which is targeted by a gRNA. The major editing window is 8 to 13 bases following the PAM site. An "off-target edit" is an indel or base change other than C to T inside of the gRNA targeted region or a base change or an indel outside the gRNA targeted region.

A "site-directed modifying polypeptide" modifies the target DNA (e.g., cleavage or methylation of target DNA) and/or a polypeptide associated with target DNA (e.g., methylation or acetylation of a histone tail). A site-directed modifying polypeptide is also referred to herein as a "site-directed polypeptide" or an "RNA binding site-directed modifying polypeptide." The site-directed modifying polypeptide interacts with the guide RNA, which is either a single RNA molecule or a RNA duplex of at least two RNA molecules, and is guided to a DNA sequence (e.g. a chromosomal sequence or an extrachromosomal sequence, e.g. an episomal sequence, a minicircle sequence, a mitochondrial sequence, a chloroplast sequence, etc.) by virtue of its association with the guide RNA.

In some cases, the site-directed modifying polypeptide is a naturally-occurring modifying polypeptide. In other cases, the site-directed modifying polypeptide is not a naturally-occurring polypeptide (e.g., a chimeric polypeptide or a naturally-occurring polypeptide that is modified, e.g., mutation, deletion, insertion). Exemplary naturally-occurring site-directed modifying polypeptides are known in the art (see for example, Makarova et al., 2017, Cell 168: 328-328.e1, and Shmakov et al., 2017, Nat Rev Microbiol 15 (3): 169-182, both herein incorporated by reference). These naturally occurring polypeptides bind a DNA-targeting RNA, are thereby directed to a specific sequence within a target DNA, and cleave the target DNA to generate a double strand break.

A site-directed modifying polypeptide comprises two portions, an RNA-binding portion and an activity portion. In some embodiments, the site-directed modifying polypeptide comprises: (i) an RNA-binding portion that interacts with a DNA-targeting RNA, wherein the DNA-targeting RNA comprises a nucleotide sequence that is complementary to a sequence in a target DNA; and (ii) an activity portion that exhibits site-directed enzymatic activity (e.g., activity for DNA methylation, activity for DNA cleavage, activity for histone acetylation, activity for histone methylation, etc.), wherein the site of enzymatic activity is determined by the DNA-targeting RNA. In other embodiments, a site-directed modifying polypeptide comprises: (i) an RNA-binding portion that interacts with a DNA-targeting RNA, wherein the DNA-targeting RNA comprises a nucleotide sequence that is complementary to a sequence in a target DNA; and (ii) an activity portion that modulates transcription within the target DNA (e.g., to increase or decrease transcription), wherein the site of modulated transcription within the target DNA is determined by the DNA-targeting RNA.

In some cases, the site-directed modifying polypeptide has an operably-linked heterologous domain. The heterologous domain may be an enzyme or a signal peptide. In aspects where the heterologous domain is an enzymatic domain, that domain possesses enzymatic activity that modifies target nucleic acid (e.g., nuclease activity, methyltransferase activity, demethylase activity, DNA repair activity, DNA damage activity, deamination activity, reverse transcriptase activity, dismutase activity, alkylation activity, methylation activity, depurination activity, oxidation activity, pyrimidine dimer forming activity, integrase activity, transposase activity, recombinase activity, polymerase activity, ligase activity, helicase activity, photolyase activity or glycosylase activity). In other cases, the site-directed modifying polypeptide has an operably-linked enzymatic domain whose enzymatic activity modifies a polypeptide (e.g., a histone) associated with target DNA (e.g., methyltransferase activity, demethylase activity, acetyltransferase activity, deacetylase activity, kinase activity, phosphatase activity, ubiquitin ligase activity, deubiquitinating activity, adenylation activity, deadenylation activity, SUMOylating activity, deSUMOylating activity, ribosylation activity, deribosylation activity, myristoylation activity or demyristoylation activity). Exemplary enzymatic domains include adenosine deaminase, oxidase, thymine alkyltransferase, adenine oxidase, adenosine methyltransferase, adenosine deaminase, glycosylase, whether alone or in combination with other enzymatic domains. In aspects where the heterologous domain is a signal peptide, the signal peptide may be a nuclear localization signal ("NLS"), such as the SV40 NLS.

In some cases, different site-directed modifying polypeptides, for example different Cas9 proteins (i.e., Cas9 proteins from various species) may be advantageous to use in the various provided methods of the invention to capitalize on various enzymatic characteristics of the different Cas9 proteins (e.g., for different PAM sequence preferences; for increased or decreased enzymatic activity; for an increased or decreased level of cellular toxicity; to change the balance between NHEJ, homology-directed repair, single strand breaks, double strand breaks, etc.). Cas9 proteins from various species (for example, those disclosed in Shmakov et al., 2017, or polypeptides derived therefrom) may require different PAM sequences in the target DNA. Thus, for a particular Cas9 enzyme of choice, the PAM sequence requirement may be different than the 5'-N GG-3' sequence (where N is either a A, T, C, or G) known to be required for Cas9 activity. Many Cas9 orthologues from a wide variety of species have been identified herein and the proteins share only a few identical amino acids. All identified Cas9 orthologs have the same domain architecture with a central HNH endonuclease domain and a split RuvC/RNaseH domain. Cas9 proteins share 4 key motifs with a conserved architecture; Motifs 1, 2, and 4 are RuvC like motifs, while motif 3 is an HNH-motif. In contrast, Cas12a proteins from various species may have differing PAM sequence requirements compared to the LbCas12a canonical PAM of TTTV.

The site-directed modifying polypeptide may also be a chimeric and modified CRISPR/Cas nuclease. For example, it may be a modified Cas9 "base editor". Base editing enables direct, irreversible conversion of one target DNA base into another in a programmable manner, without requiring DNA cleavage or a donor DNA molecule. For example, Komor et al (2016, Nature, 533: 420-424), teach a Cas9-cytidine deaminase fusion, where the Cas9 has also been engineered to be inactivated and not induce double-stranded DNA breaks. Additionally, Gaudelli et al (2017, Nature, doi:10.1038/nature24644) teach a catalytically impaired Cas9 fused to a tRNA adenosine deaminase, which can mediate conversion of an A/T to G/C in a target DNA sequence. Another class of engineered Cas9 nucleases which may act as a site-directed modifying polypeptide in the methods and compositions of the invention are variants which can recognize a broad range of PAM sequences, including NG, GAA, and GAT (Hu et al., 2018, Nature, doi:10.1038/nature26155).

Embodiments

In one embodiment, we provide a fusion protein comprising in the N-terminus to C-terminus direction a heterologous domain, a first linker sequence, and a Type V CRISPR-Cas enzyme, wherein the first linker sequence comprises a repeated GGGGS sequence. In one aspect, the heterologous domain is a deaminase, polymerase, nuclease, relaxase, alkyltransferase, methyltransferase, adenosine deaminase, cytidine deaminase, oxidase, thymine alkyltransferase, adenine oxidase, adenosine methyltransferase, glycosylase or nuclear localization signal. In another aspect, the heterologous domain is a deaminase domain. In yet another aspect, the deaminase domain is a cytidine deaminase. In another aspect, the cytidine deaminase domain is an activation-induced cytidine deaminase ("AID"). In yet another aspect, the cytidine deaminase domain is an apolipoprotein B mRNA-editing complex ("APOBEC") domain. In another aspect, the APOBEC domain is an APOBEC1 family deaminase. In yet another aspect, the APOBEC domain comprises a sequence at least 70% identical to SEQ ID NO: 1. In another aspect, the deaminase domain is an adenine deaminase. In yet another aspect, the adenine deaminase is a TadA domain comprising a sequence at least 70% identical to SEQ ID NO: 92.

In one aspect, the type V CRISPR-Cas enzyme is a type V-A ("Cas12a") enzyme. In another aspect, the Cas12a domain is selected from the group comprised of SEQ ID NO: 3, SEQ ID NO: 6, SEQ ID NO: 22, SEQ ID NO: 45, SEQ ID NO: 46, SEQ ID NO: 47, and SEQ ID NO: 48. In yet another aspect, the Cas12a domain is catalytically inactive and selected from the group comprised of SEQ ID NO: 3, SEQ ID NO: 6, and SEQ ID NO: 22.

In one aspect, the first linker sequence comprises GGGGS repeated at least three times. In another aspect, the first linker sequence comprises GGGGS repeated at least six times.

In one aspect, the fusion protein comprises the sequence selected from the group consisting of SEQ ID NO: 11, 12, 13, and 44. In another aspect, the fusion protein is further comprising a uracil DNA glycosylase inhibitor ("UGI")

domain. In yet another aspect, the UGI domain comprises SEQ ID NO: 8. In another aspect, the UGI domain is linked to the Cas12a enzyme by a second linker comprising the sequence SGGS. In yet another aspect, the fusion protein comprises a sequence selected from the group consisting of, SEQ ID NO: 17, SEQ ID NO: 24, SEQ ID NO: 35, SEQ ID NO: 39, SEQ ID NO: 43, SEQ ID NO: 50, SEQ ID NO: 52, SEQ ID NO: 54, SEQ ID NO: 56, SEQ ID NO: 81, SEQ ID NO: 83, SEQ ID NO: 85, SEQ ID NO:87, and SEQ ID NO:89. In another aspect, the fusion protein when contacted with DNA produces on-target edits at an increased frequency and off-target edits at a reduced frequency compared to a fusion protein having a first linker sequence other than a repeated GGGGS sequence.

In another embodiment, we provide a method of editing plant genomic DNA, the method comprising contacting plant genomic DNA with: (a) the fusion protein of the above aspects and optionally comprising a UGI domain; and (b) a guide RNA ("gRNA") targeting the fusion protein of step (a) to a target DNA sequence of the plant genomic DNA; wherein the edited plant genomic DNA comprises reduced off-target edits compared to plant genomic DNA edited by a fusion protein having a first linker other than a repeated GGGGS sequence.

In another embodiment, we provide a method of editing plant genomic DNA with reduced off-target edits, the method comprising contacting plant genomic DNA with: (a) the fusion protein of the above aspects and optionally comprising a UGI domain; and (b) a guide RNA ("gRNA") targeting the fusion protein of step (a) to a target DNA sequence of the plant genomic DNA; wherein the edited plant genomic DNA comprises reduced off-target edits compared to plant genomic DNA edited by a fusion protein having a first linker other than a repeated GGGGS sequence. In aspect, the fusion protein comprises SEQ ID NO: 24.

In another embodiment, we provide a method of obtaining a population of edited plants with reduced off-target edits, the method comprising: (a) obtaining a population of plant cells comprising genomic DNA to be edited; (b) obtaining a nucleotide sequence encoding the fusion protein of the above aspects and optionally a UGI domain; (c) transforming the population of plant cells with the nucleotide sequence of step (b), thereby expressing the fusion protein encoded by the nucleic acid sequence within the population of plant cells; (d) growing the transformed population of plant cells into plants, wherein at least one of the plants is edited; and (e) selecting the at least one edited plant from the product of step (d), thereby obtaining a population of edited plants; wherein the population of edited plants comprises reduced off-target edits compared to plants edited by a fusion protein having a first linker other than a repeated GGGGS sequence. In one aspect, the nucleotide sequence encoding the fusion protein comprises SEQ ID NO: 17, SEQ ID NO: 24, SEQ ID NO: 35, SEQ ID NO: 39, SEQ ID NO: 43, SEQ ID NO: 50, SEQ ID NO: 52, SEQ ID NO: 54, SEQ ID NO: 56, SEQ ID NO: 81, SEQ ID NO: 83, SEQ ID NO: 85, SEQ ID NO:87, and SEQ ID NO:89. In some embodiments, codon optimized polynucleotides encoding fusion proteins including one or more DNA binding domains and one or more DNA modifying domains connected by improved linker sequences are provided.

EXAMPLES

The following Examples provide illustrative embodiments. In light of the present disclosure and the general level of skill in the art, those of skill will appreciate that the following Examples are intended to be exemplary only and that numerous changes, modifications, and alterations can be employed without departing from the scope of the presently disclosed subject matter.

Example 1. Construction of Vectors for dLbCas12a-BE and Guide RNA Expression

We fused the catalytically inactive *Lachnospiraceae bacterium* Cas12a which contained D832A/E925A/D1148A mutations (here after "dLbCas12a," previously known as dLbCpf1), rat cytidine deaminase (APOBEC1) and uracil DNA glycosylase inhibitor (UGI), which linked by the amino acid linkers as one protein to make use of the beneficial properties for base editing in plants. The fusion constructs were optimized for *Zea mays* codon and synthesized commercially (GenScript, Nanjing, China), and cloned under the sugarcane Ubiquitin-4 (SoUbi4) gene promoter to generate the dLbCas12a-BE constitutively.

In dLbCas12a-BE of construct 24524, a nuclear localization signal (SV40-NLS) proceeded the APOBEC1 linked by XTEN protein linker to the dLbCas12a, and followed by a SV40-NLS linked by SGGS linker to the UGI. A SV40-NLS was also incorporated into the C-terminus of UGI by SGGS linker to improve the fusion protein targeting into nucleus. A synthetic sequence for dLbCas12a-BE made with maize optimized codons is set forth in SEQ ID NO: 18.

In dLbCas12a-BE of construct 24904, a SV40-NLS proceeded the APOBEC1 linked by a 30 amino acid linker GGGGS GGGGS GGGGS GGGGS GGGGS GGGGS (SEQ ID NO: 11) with six GGGGS amino acids repeats, referred to as (G4S)x6, to the dLbCas12a, and followed by a SV40NLS linked by SGGS linker to the UGI. A SV40-NLS was also incorporated into the C-terminus of UGI by a SGGS linker to improve the fusion protein targeting into nucleus. A synthetic sequence for dLbCas12a-BE made with maize optimized codons is set forth in SEQ ID NO: 23.

In dLbCas12a-BE of construct 25057, a SV40-NLS proceeded the APOBEC1 linked by XTEN protein linker to the dLbCas12a, and followed by a SV40-NLS linked by a 18 amino acids linker GGSTG GGSGG GSGGG SSG (SEQ ID NO: 12), referred to as SX, to the UGI. A SV40-NLS was also incorporated into the C-terminus of UGI by a 15 amino acid linker GGGGS GGGGS, referred to as (G4S)x3 to improve dLbCas12a-BE targeting into nucleus. A synthetic sequence for dLbCas12a-BE made with maize optimized codons is set forth in SEQ ID NO: 14.

In dLbCas12a-BE of construct 25058, a SV40-NLS proceeded the APOBEC1 linked by a 30 amino acid linker (G4S)x6, to the dLbCas12a, and followed by a SV40-NLS linked by a SX linker to the UGI. A SV40-NLS was also incorporated into the C-terminus of UGI by a (G4S)x3 to improve dLbCas12a-BE targeting to nucleus. A synthetic sequence for dLbCas12a-BE made with maize optimized codons is set forth in SEQ ID NO: 16.

In the dLbCas12a-BE constructs, the CRISPR/Cas12a guide RNA transcript is expressed under the control of the SoUbi4 promoter which targets the corn Waxy1 4th exon region to change C9, C10 or C22 to T following the PAM sequence in Exon4. It also included direct repeat of LbCrRNA as the scaffold. A synthetic sequence for guide RNA is set forth in SEQ ID NO: 26.

In construct 24784, a nuclear localization signal (xSV40NLS-06) proceeded the cytidine deaminase (xAPOBEC1-01) linked by xXTEN-02 to the maize-optimized Cas9 gene (cCas9BE-02) followed by a nuclear localization signal (xSV40NLS-04) linked by xSGGSlinker- 02 to the uracil DNA glycosylase inhibitor xUGI-02 linked by xSGGSlinker-02 to the nuclear localization signal xSV40NLS-07. The fusion protein was driven under the control of sugarcane ubiquitin-4 promoter (prSoUbi4-02) followed by the NOS terminator (tNOS-05-01). Cas9 protein is nickase Cas9 mutation with D10A fused to rat APOBEC1 and uracil DNA glycosylase inhibitor (UGI). A nuclear localization signal was also incorporated into the C-terminus of Cas9 to improve its targeting to nucleus. A synthetic sequence for cCas9BE-02 is set forth in SEQ ID NO: 20.

Example 2. *Agrobacterium*-Mediated Transformation of Corn Embryos

To generate potential events with edited in maize Wx1, elite maize transformation variety NP2222 was chosen for all experiments as described (WO16106121, incorporated by reference herein).

Corn variety NP2222 is employed for corn transformation. Corn ears were harvested from GH when immature embryos are around 1.2 mm, then sterilized ears with 20% Clorox solution for 20 minutes and rinsed with sterile water 3 times.

*Agrobacterium tumefaciens* strains LBA4404 17740 RecA⁻ harboring a vector by electroporation was streaked out on YP medium containing Gent (25 µg/ml) and Spec (100 µg/ml) antibiotics and grown at 28° C. for 2 days. Prior to transformation, a single colony was selected and streaked onto a fresh YP plate and grown for 1 day at 28° C. *Agrobacterium* was re-suspended using inoculation medium. The OD$_{660}$ was adjusted to 0.25.

We removed the endosperms, then isolated and collected immature embryos together with a sterilized scalpel and infused them in *Agrobacterium* suspension for two to three minutes. The infected immature embryos were transferred to co-culture medium under 22° C. for two to four days.

After co-culture stage, the embryos were transferred to medium with selection agent for four weeks under 28° C. dark condition. Resistant embryogenic calli were transferred to regeneration medium and cultured under 28° C. with 16/8 light period condition. After about three weeks, regenerated plantlets were transferred to a growth container with rooting medium under same culture temperature and light condition.

Example 3. Analyzing Edited Bases in Targeted Region

We used Phire Plant Direct PCR Master Mix (Thermo Fisher, F160L) to amplify DNA fragment approximately 410 bp which contains the targeted region directly from corn leaf samples. No DNA purification is required prior to PCR. The amplified DNA fragment was conducted by Sanger DNA sequencing to analyze the mutation of target site.

The DNA extraction and PCR amplification was performed following manufacturer's recommendation. A piece of young leaf (e.g. a punch approximately 2 mm in diameter) was placed in 30 µL of Dilution Buffer. The leaf sample was crushed with a 100 µL pipette tip by pressing briefly against the tube wall, and adding 20 µIL of Dilution Buffer. After crushing the leaf, the solution was greenish in color. The plant material down was spun down in a centrifuge, and 1 µL of the supernatant was used as a template for a 20 µL PCR reaction.

The PCR system consists of:

| Reagent | Volume |
|---|---|
| H₂O | 8.6 µL |
| 2X Phire Plant Direct PCR Master Mix | 10 µL |
| Forward Primer (10 µM) | 0.2 µL |
| Reverse Primer (10 µM) | 0.2 µL |
| Plant tissue from Dilution | 1 µL |
| Total Volume: | 20 µL |

PCR Primers for ZmWaxy1:

```
Forward primer:
                        (SEQ ID NO: 29)
5'-AGATGGGAGACGGGTACGAGACGG-3'

Reverse primer:
                        (SEQ ID NO: 30)
5'-GTATGGGTTGTTGTTGAGGCTCAGG-3'

DNA sequencing primer:
                        (SEQ ID NO: 31)
5'-GACCACCCACTGTTCCTGGAGAGGG-3'
```

PCR Conditions:
98° C. for 5 minutes;
35 cycles of: 98° C. for 5 seconds followed by 60° C. for 5 seconds;
72° C. for 20 seconds;
72° C. for 1 minute; and
hold at 4° C. until ready for analysis.

Sequencing:
PCR product was separated by agarose gel electrophoresis and purified prior to Sanger DNA sequencing by the specific primer. For the heterozygous mutation, the double peak was observed at the target nucleotide positions while a unique single peak which is differ to control regarded as homozygous mutation. Transgenic events for constructs 24524, 24904, and 24784 were used to amplify the ZmWxy1 Exon 4 region for sequencing to assess the base editing.

TABLE 1

A CRISPR/Cas cytidine base editor ("CBE") APOBEC comprising an XTEN linker between the cytidine deaminase and nickase Cas9 ("nCas9-CBE")

nCAS9-BE3 construct
24784 (SEQ ID NOS:
20 and 21)
ZmWaxy exon 4 region
position following PAM

| site | -2 | 5 | 6 | 7 | 18 | 49 |
|---|---|---|---|---|---|---|
| Target | G | C | C | G | C | G |
| 1 | G | C | C | G | C | G |
| 2 | G | T | C | G | C | G |
| 3 | G | T | T | G | C | G |
| 4 | G | T | T | G | C | G |
| 5 | G | T | T | G | C | G |
| 6 | G | T | T | G | C | G |
| 7 | G | T | T | G | C | G |
| 8 | G | T | T | G | C | G |
| 9 | G | T | T | G | C | G |
| 10 | G | T | T | G | C | G |
| 11 | G | T | T | G | T | G |
| 12 | G | T | T | G | C | G |
| 13 | G | C | G | G | C | G |
| 14 | G | T | G | G | C | G |
| 15 | G | T | T | A | C | G |

TABLE 1-continued

| A CRISPR/Cas cytidine base editor ("CBE") APOBEC comprising an XTEN linker between the cytidine deaminase and nickase Cas9 ("nCas9-CBE") | | | | | | |
|---|---|---|---|---|---|---|
| nCAS9-BE3 construct 24784 (SEQ ID NOS: 20 and 21) ZmWaxy exon 4 region position following PAM site | −2 | 5 | 6 | 7 | 18 | 49 |
| 16 | G | A | T | G | C | G |
| 17 | A | T | T | G | C | G |
| 18 | A | T | T | G | C | A |

The edited nucleotides are shown in bold font. As shown above, this version of Cas12a base editor, comprising an XTEN linker between the APOBEC domain and the site-directed nuclease, edited the cysteines into thiamines most efficiently at positions 5 and 6. However, there are instances of a guanine to adenine edit at positions −2, 7, and 49. Positions are determined by the number of nucleotides away they are from the start of the PAM site.

TABLE 2

| A CRISPR/Cas cytidine base editor comprising an XTEN linker between the APOBEC deaminase and dLbCas12a | | | | | | | |
|---|---|---|---|---|---|---|---|
| CAS12a BE construct 24524 (SEQ ID NOS: 18 and 19) ZmWaxy exon 4 region position following PAM site | 9 | 10 | 22 | 39 | 44 | 52 | 53 |
| Target | C | C | C | G | G | G | G |
| 1 | C | T | C | G | G | G | G |
| 2 | C | T | C | G | G | G | G |
| 3 | C | C | T | G | G | G | G |
| 4 | T | T | C | G | G | G | G |
| 5 | T | T | C | G | G | G | G |
| 6 | T | T | C | G | G | G | G |
| 7 | C | C | C | A | G | G | G |
| 8 | C | C | C | G | A | G | G |
| 9 | C | C | C | G | G | G | A |
| 10 | C | C | C | G | G | G | A |
| 11 | C | C | C | G | G | G | A |
| 12 | C | C | C | G | G | G | A |
| 13 | C | C | C | G | G | G | A |
| 14 | C | C | C | G | G | G | A |
| 15 | C | C | C | G | G | G | A |
| 16 | C | C | C | G | G | A | A |

The edited nucleotides are shown in bold font. In this version, the Cas12a base editor, comprising an XTEN linker between the APOBEC domain and the deactivated site-directed nuclease, edited the cysteines into thiamines at positions 9, 10, and 22, and edited guanines into adenines at positions 39, 44, 52, and notably at 53. Where the guanines are edited into adenines indicates that the editing occurred on the complement strand.

TABLE 3

| A CRISPR/Cas cytidine base editor comprising a long linker between the deaminase and dLbCas12a | | | | |
|---|---|---|---|---|
| CAS12a BE construct 24904 (SEQ ID NOS: 23 and 24) ZmWaxy exon 4 region position following PAM site | 9 | 10 | 19 | 53 |
| Target | C | C | G | G |
| 1 | T | C | G | G |
| 2 | T | C | G | G |
| 3 | T | C | G | G |
| 4 | T | T | G | G |
| 5 | T | T | G | G |
| 6 | T | T | G | G |
| 7 | T | T | G | G |
| 8 | T | T | G | A |
| 9 | T | T | G | A |
| 10 | T | T | A | G |

The edited nucleotides are shown in bold font. In this version, the Cas12a base editor, comprising a long linker comprising (G4S)6 between the APOBEC domain and the deactivated site-directed nuclease, edited the cysteines into thiamines at positions 9 and 10, and edited guanines into adenines at positions 19, and 53. Where the guanines are edited into adenines indicates that the editing occurred on the complement strand Example 4. Measuring Editing Efficiency

TABLE 4

| Base editing efficiency of corn Wxy1 by dLbCas12a-CBE system. | | | | | |
|---|---|---|---|---|---|
| Construct ID | Description | No. of PMI+ events | C toT mutation at gRNA region | Homologous editing | G to A mutation out of gRNA region | Total mutation efficiency |
| 24784 | nCas9-BE3 | 86 | 75 (87.2%) | 35 (40.7%) | 6 (7%) | 87.2% |
| 24524 | dLbCas12a-BE with XTEN linker | 292 | 6 (2.1%) | 0 | 10 (3.4%) | 5.6% |
| 24904 | dLbCas12a-BE with (G4S) | 192 | 131 (68.2%) | 29 (15.1%) | 3 (1.5%) | 68.2% |

Table 4 shows how base editing efficiency of Cas12a with a long linker is comparable to the base editing efficiency of Cas9. Without optimization, Cas12aBE has a poor editing efficiency at approximately 5%; far below that of Cas9 (at 87%). However, by adding a long linker to operably link the deaminase to catalytically inactive Cas12a, editing efficiency improved by 12-fold.

TABLE 5

Editing efficiency of SBEIIb by LbCas12a with long linker.

| Construct ID | Description | No. of PMI+ events | Homologous editing | Total mutation efficiency |
|---|---|---|---|---|
| 24523 | NLS-LbCas12a-NLS using XTEN linker | 93 | 0 | 4(4.3%) |
| 25181 | NLS-(G4S)6-LbCas12a-NLS-NLS | 48 | 0 | 9(18.8%) |

Table 5 shows a direct comparison between the editing efficiency of LbCas12a base editor when operably linked to either an XTEN linker or the long linker. Editing efficiency of a difficult target is improved nearly 5-fold when the deaminase is operably linked to a site-directed nuclease by a long linker, such as $(G_4S)_6$.

TABLE 6

Editing efficiency of Waxy1 by LbCas12a with long linker.

| Construct ID | Description | No. of PMI+ events | Homologous editing | Total mutation efficiency |
|---|---|---|---|---|
| 25173 | NLS-(G4S)6-LbCas12a-NLS-NLS | 30 | 29 | 29(96.7%) |
| 25268 | NLS-APOBEC1-(G4S)6-LbCas12a-NLS-xUGI-NLS | | | 67% |

TABLE 7

Multiplexed editing of SBEIIb, V Waxy1, and Glossy2 by LbCas12a with long linker.

| Construct ID | Description | No. of PMI+ events | Homologous editing | Total mutation efficiency |
|---|---|---|---|---|
| 25175 | NLS-(G4S)6-LbCas12a-NLS-NLS | 33 | 0 (0%) | SBEIIb: 21.2% |
| | | 38 | 4 (10.5%) | Waxy1: 92.1% |
| | | 42 | 12 (28.5%) | Glossy2: 100% |

Multiple simultaneous editing using several guide RNA molecules within the same construct ("multiplexing" or "multiplexed editing"), as well as having the long linker between the nuclear localization signal and the active Cas12a, achieves high editing efficiency. Even challenging targets, such as SBEIIb, achieved acceptable editing efficiencies when part of a multiplexed editing experimental design.

Example 5. Improved Editing in Soy

Soybean editing using the long linker and Cas12a combination is also vastly improved. GmFAD2 editing by standard Cas12a and long linker-Cas12a is improved by nearly 7-fold.

TABLE 8

GmFAD2 editing

| Construct ID | Description | No. of Spec+ events | High quality editing | Total mutation efficiency |
|---|---|---|---|---|
| 25205 | NLS-LbCas12a-NLS | 68 | 0% | 9% |
| 25513 | NLS-(G4S)6-LbCas12a-NLS-NLS | 77 | 34% | 69% |

Example 6. Long Linker Improved Mb2Cas12a Editing in Corn

The long linker also improves the editing efficiency of additional Cas12 enzymes, such as Mb2Cas12a.

TABLE 9

Editing by Mb2Cas12a with long linker.

| Construct ID | Description | No. of PMI+ events | Homologous editing | Total mutation efficiency |
|---|---|---|---|---|
| 25220 | NLS-Mb2Cas12a-NLS | 85 | 0% | 0% |
| 25382 | NLS-(G4S)6-Mb2Casl2a-NLS-NLS | 61 | 0% | 46% |
| 25457 | NLS-(G4S)6-dMb2Cas12a | 93 | 22 (23.7%) | 83 (91.4%, (ZmWaxy1 target) |

Without the long linker, Mb2Cas12a made no edits to the target sequence. However, with the long linker, the editing efficiency is significantly improved.

Example 7. Other Heterologous Domains Operably Linked to a Cas12a, Connected by a Long Linker It is within the scope of the present invention to tether heterologous domains (beyond only APOBEC deaminases) to Cas12a by way of a long linker. Such heterologous domains include, but are not limited to, a deaminase, polymerase, nuclease, relaxase, alkyltransferase, methyltransferase, adenosine deaminase, cytidine deaminase, oxidase, thymine alkyltransferase, adenine oxidase, adenosine methyltransferase, glycosylase or nuclear localization signal.

We operably linked an adenine deaminase to Cas12a to create a Cas12a adenine base editor ("Cas12a-ABE"). We fused a catalytically inactive LbCas12a (containing D832A, E925A, and D1148A mutations) to *E. coli* wild adenine deaminase ("TadA" engineered to contain W23R, H36L, P48A, R51L, L84F, A106V, D108N, H123Y, S146C, D147Y, R152P, E155V, I156F, and K157N amino acid substitutions) operably linked by amino acid linkers. The fusion constructs were optimized for Zea mays codon and synthesized commercially (GenScript, Nanjing, China), and contained cloned under the sugarcane Ubiquitin-4 (SoUbi4) gene promoter to generate the dLbCal2a-ABE constitutively.

In dLbCas12a-ABE of construct 25459, a 189 bp potato intron was inserted into TadA coding sequence proceeded by TadA variant linked by XTEN protein linker to create the TadA dimer. This was fused to dLbCas12a, and a SV40-NLS was also incorporated into the C-terminus of dLbCas12a by GS linker to improve the fusion protein targeting into nucleus. A synthetic sequence for dLbCas12a-ABE made with maize optimized codons is set forth in SEQ ID NO: 79.

In dLbCas12a-ABE of construct 25504, a 189 bp potato intron was inserted into TadA coding sequence proceeded by TadA variant to create the TadA dimer. This was linked to the dLbCas12a by a 30 amino acid linker (G4S)x6 protein linker, and a SV40-NLS was also incorporated into the C-terminus of dLbCas12a by GS linker to improve the fusion protein targeting into nucleus. A synthetic sequence for dLbCas12a-ABE made with maize optimized codons is set forth in SEQ ID NO: 81.

In the dLbCas12a-ABE constructs, the CRISPR/Cas12a guide RNA transcript is expressed under the control of the SoUbi4 promoter which targets the corn Waxy1 gene. It also included direct repeat of LbCrRNA as the scaffold. A synthetic sequence for guide RNA is set forth in SEQ ID NO: 74.

In the experiment with construct 25459 (where the adenine deaminase was linked to dLbCas12a by the XTEN linker) yielded no detectable edits when used in maize plants. In the experiment with construct 25504, where the adenine deaminase was linked to dLbCas12a by the (G4S)*6 long linker, yielded a 7% editing efficiency, about half of the Cas9ABE control (construct 24785). See Table 10.

TABLE 10

| dLbCas12aABE | | | |
|---|---|---|---|
| Construct number | Description of Construct | Editing frequency | Notes |
| 24785 | dLbCas9-ABE7.10, A to G conversion | 19.3% | ABE control |
| 25459 | dCas12a-ABE7.10, A to G conversion | 0% | No long linker between Tad A and dLbCas12a |
| 25504 | dCas12a-ABE7.10, A to G conversion | 7.1% | Long linker between TadA and dLbCas12a |
| 25289 | dCas12a-PmCDA1, C to T conversion | 6% | PmCDA1 C to T conversion |

We believe this represents the first time a Cas12aABE has been shown to work in plants. It is believed the use of the long linker to operably link the adenine deaminase to Cas12a is responsible for this technical success.

Example 8. Dual Base Editors in Maize

Dual base editors (a cytidine deaminase domain and an adenine deaminase domain fused to a Cas enzyme). In this concept, targeted saturation mutagenesis of crop genes could be applied to produce genetic variants with improved agronomic performance, e.g., C:G>T:A and A:T>G:C substitutions at the same target region. We multiplexed four guide RNAs: one targeting the ZmWaxy1 gene, and three distinct guide RNAs targeting the ZmADH gene.

TABLE 11

| Editing frequency by dual CBE-ABE Cas12a in maize. | | | |
|---|---|---|---|
| Construct number | Description of Construct | Editing frequency | Orientation of CBE-ABE |
| 25658 | dLbCas12a-ABE-CBE | 0% | TadA dimer-dLBCas12a-PmCDA1-UGI |
| 25701 | dLbCas12a-ABE-CBE | 1.1% | PmCDA1-TadA dimer-dLbCas12a-UGI |
| 25702 | dLbCas12a-ABE-CBE | 0% | TadA dimer-PmCDA1-dLbCas12a-UGI |

TABLE 12

| | | Edits by dual CBE-ABE Cas12a in maize. | | | | | | | |
|---|---|---|---|---|---|---|---|---|---|
| | No. PMI | ZmWaxy1 | | ZmADH1-1 | | ZmADH1-2 | | ZmADH1-3 | |
| Construct | events | C to T | A to G | C to T | A to G | C to T | A to G | C to T | A to G |
| 25658 | 61 | 10 | 0 | 0 | 0 | 0 | 0 | 0 | 0 |
| 25701 | 85 | 7 | 1 | 0 | 0 | 0 | 0 | 0 | 0 |
| 25702 | 38 | 7 | 0 | 1 | 0 | 0 | 0 | 0 | 0 |

In total, CBE-ABE based on dLbCas12a is 1% C to T and A to G mutation. Adding an intron increased vector stability, but may reduce the enzyme activity from inefficient splicing. This is believe to be the first instance of dual CBE-ABE editing in plants using Cas12a.

Summary Table

| Construct ID | Target (SEQ ID NO.) | Fusion Protein SEQ ID NO. | Heterologous Enzymatic Domain | Linker | Enzyme | Cas (Active, Inactive, or Nickase) |
|---|---|---|---|---|---|---|
| 25057 | Waxy (26) | 15 | APOBEC | XTEN | dLbCas12a | Inactive |
| 25058 | Waxy (26) | 17 | APOBEC | (G4S)6 | dLbCas12a | Inactive |
| 24524 | Waxy (26) | 19 | APOBEC | XTEN | dLbCas12a | Inactive |
| 24904 | Waxy (26) | 24 | APOBEC | (G4S)6 | dLbCas12a | Inactive |
| 24523 | SBE (71) | 33 | NLS | XTEN | LbCas12a | Active |
| 25181 | SBE (71) | 35 | NLS | (G4S)6 | LbCas12a | Active |
| 25205 | GmFad2 (73) | 37 | NLS | XTEN | LbCas12a | Active |
| 25513 | GmFad2 (73) | 39 | NLS | (G4SG)6 | LbCas12a | Active |
| 25220 | ZmGL2 (72) | 41 | NLS | XTEN | Mb2Cas12a | Active |
| 25382 | ZmGL2 (72) | 43 | NLS | (G4SG)6 | Mb2Cas12a | Active |
| 25457 | Waxy (26) | 50 | APOBEC | (G4S)6 | dMb2Cas12a | Inactive |
| 24784 | Waxy (27) | 21 | APOBEC | XTEN | nCas9 | Nickase |
| 25268 | Waxy (26) | 52 | APOBEC | (G4S)6 | LbCas12a | Active |
| 25173 | Waxy (26) | 54 | NLS | (G4S)6 | LbCas12a | Active |
| 25175 | Multiplexed: Waxy (26); SBE (71); GL2 (72) | 56 | NLS | (G4S)6 | LbCas12a | Active |
| 25504 | Waxy (26) | 81 | Tad A dimer | (G4S)6 | LbCas12a | Inactive |
| 24785 | Waxy (27) | 77 | Tad A dimer | XTEN | Cas9 | Nickase |
| 25459 | Waxy (26) | 79 | Tad A dimer | XTEN | LbCas12a | Inactive |
| 25702 | Multiplexed: Waxy (26); ADH (90) | 89 | Tad A dimer PmCDA | (G4S)6 | LbCas12a | Inactive |
| 25701 | Multiplexed: Waxy (26); ADH (90) | 87 | PmCDA Tad A dimer | (G4S)6 | LbCas12a | Inactive |
| 25658 | Multiplexed: Waxy (26); ADH (90) | 85 | Tad A dimer PmCDA | (G4S)6 | LbCas12a | Inactive |
| 25289 | Waxy (26) | 83 | PmCDA | (G4S)6 | LbCas12a | Inactive |

In the table above, most Cas12aBE constructs follow the pattern of Heterologous Enzymatic Domain-Linker-Cas Enzyme. Exceptions to this pattern are: 25702 [TadA dimer-Linker-PmCDA-Linker-Cas Enzyme], 25701 [PmCDA-Linker-TadA dimer-Linker-Cas Enzyme], and 25658 [TadA dimer-Linker-Cas Enzyme-PmCDA]. Additional nuclear localization sequences, uracil glycosylase inhibitors, and other components may be present but not displayed in this table. Such details are present in the sequences provided in the accompanying sequence listing.

The examples and embodiments provided herein are non-limiting illustrations of the claims and are not to be interpreted as the sole working examples. Additional variations may be practiced by one skilled in the art.

SEQUENCE LISTING (92 sequences)

SEQ ID NO: 1 - protein, 229 aa, Rattus norvegicus [sequence omitted]

SEQ ID NO: 2 - DNA, 687 bp, Artificial Sequence
  Synthetic
atgtccagcgagaccggccccgtggcggtggaccccaccctgcgcaggcgcatcgagccgcacgagttcgaggtgttcttcgaccccagggagctccgcaaggagacctgcctcctgtacgagatcaactggggcggcaggcactccatctggaggcacacgagccagaacaccaacaagcacgtcgaggtgaacttcatcgagaagttcaccacggagaggtacttctgcccgaacacgcgctgctccatcacgtggttcctctcgtggagcccatgcggcgagtgctccagggcgatcacggagttcctcagccgctacccgcacgtgaccctgttcatctacatcgctaggctctaccaccacgcggaccccaggaacaggcagggcctcagggacctgatctccagcggcgtcacgatccagatcatgaccgagcaggagtccggctactgctggaggaacttcgtgaactactccccgagcaacgaggcccactggccccgctacccgcacctctgggtccgcctctacgtgctcgagctgtactgcatcatcctcggcctgccgccctgcctcaacatcctgaggcgcaagcagccccagctgacgttcttcaccatcgccctgcagagctgccactaccagaggctcccgccccacatcctgtgggcgaccgggctcaag

SEQ ID NO: 3 - protein, 1251 aa, Moraxella bovis
MLFQDFTHLYPLSKTVRFELKPIGRTLEHIHAKNFLSQDETMADMYQKVKVILDDYHRDFIADMMGEVKLTKLAEFYDVYLKFRKNPKDDGLQKQLKDLQAVLRKESVKPIGSGGKYKTGYDRLFGAKLFKDGKELGDLAKFVIAQEGESSPKLAHLAHFEKFSTYFTGFHDNRKNMYSDEDKHTAIAYRLIHENLPRFIDNLQILTTIKQKHSALYDQIINELTASGLDVSLASHLDGYHKLLTQEGITAYNRIIGEVNGYTNKHNQICHKSERIAKLRPLHKQILSDGMGVSFLPSKFADDSEMCQAVNEFYRHYTDVFAKVQSLFDGFDDHQKDGIYVEHKNLNELSKQAFGDFALLGRVLDGYYVDVVNPEFNERFAKAKTDNAKAKLTKEKDKFIKGVHSLASLEQAIEHHTARHDDESVQAGKLGQYFKHGLAGVDNPIQKIHNNHSTIKGFLERERPAGERALPKIKSGKNPEMTQLRQLKELLDNALNVAHFAKLLTTKTTLDNQDGNFYGEFGVLYDELAKIPTLYNKVRDYLSQKPFSTEKYKLNFGNPTLLNGWDLNKEKDNFGVILQKDGCYYLALLDKAHKKVFDNAPNTGKNVYQKMVYKLLPGPNKMLPKVFFAKSNLDYYNPSAELLDKYAKGTHKKGDNFNLKDCHALIDFFKAGINKHPEWQHFGFKFSPTSSYRDLSDFYREVEPQGYQVKFVDINADYIDELVEQGKLYLFQIYNKDFSPKAHGKPNLHTLYFKALFSEDNLADPIYKLNGEAQIFYRKASLDMNETTIHRAGEVLENKNPDNPKKRQFVYDIIKDKRYTQDKFMLHVPITMNFGVQGMTIKEFNKKVNQSIQQYDEVNVIGIDRGERHLLYLTVINSKGEILEQRSLNDITTASANGTQVTTPYHKILDKREIERLNARVGWGEIETIKELKSGYLSHVVHQINQLMLKYNAIVVLEDLNFGFKRGRFKVEKQIYQNFENALIKKLNHLVLKDKADDEIGSYKNALQLTNNFTDLKSIGKQTGFLFYVPAWNTSKIDPETGFVDLLKPRYENIAQSQAFFGKFDKICYNTDKGYFEFHIDYAKFTDKAKNSRQKWAICSHGDKRYVYDKTANQNKGAAKGINVNDELKSLFARYHINDKQPNLVMDICQNNDKEFHKSLMCLLKTLLALRYSNASSDEDFILSPVANDEGVFFNSALADDTQPQNADANGAYHIALKGLWLLNELKNSDDLNKVKLAIDNQTWLNFAQNR

SEQ ID NO: 4 - DNA, 3753 bp, Artificial Sequence
  Codon optimized
gctctgtttcaagattttacacatctgtacccgctgagtaaaacagtgcggttcgagctgaaacccataggaaggaccctcgagcacatccacgcgaagaattttctgagccaggatgaaactatggctgatatgtatcaaaaagttaaggtcattttggacgactatcatcgcgattttattgccgacatgatgggagaggtgaaactcacgaagcttgctgaattttacgacgtctatctgaagttcaggaaaaatcctaaggacgatgggctgcaaaaacagcttaaagaccttcaagctgtccttcggaaggaatcggtgaagcctatagggtcaggtgggaagtacaaaacaggctacgatagactctttggggcaaaactcttcaaagatggaaaagagttgggtgacctcgcaaaattcgttatagcccaagaaggtgagtcttctccgaagctggctcatcttgctcattttgagaagttcagcacgtattttactggatttcacgataatcggaagaatatgtactcggatgaagacaagcatactgcaatagcgtacaggctcatccatgagaatttgccgagattcatcgacaatctgcaaatcttgacaacaatcaaacaaaagcatagcgccctctatgatcagataatcaacgagctcacggcctccgggctcgacgtctccttggcttctcatcttgacgggtatcacaagctccttacacaagaggggatcacggcatacaacaggatcataggagaggtgaatggatatacaaataagcataaccagatatgccacaagagcgagcgcatagcgaaacttagacccttgcacaagcaaatcctttctgacggaatgggagtgtcattccttccgtctaagttcgcggatgatagtgagatgtgccaagcggtcaacgaattttatcgccattatactgacgtgttcgcaaaggtgcaaagtctctttgacggatttgatgatcaccagaaagacgggatctatgttgaacacaaaaaccttaatgaactgagcaaacaggcgttcggcgactttgctttgctggggagggtccttgatggatactacgtggacgttgtcaatccggagttcaatgagcggttcgcaaaggccaagactgacaatgcgaaagccaagcttacaaaagaaaaggacaaattcattaaaggagtccactcactggcttccctcgaacaagcaatagaacaccatacagctagacacgacgatgagagtgttcaagccggaaaacttggccagtacttcaaacacggtttggcgggggttgacaacccgattcagaaaattcacaataaccattcgacgattaaagggtttctggaaagggaaaggcctgctggggaacgggcgctcccgaagatcaagtcaggaaaaaacccagaaatgacacagctcaggcagctgaaggaacttttggacaacgcattgaatgtggcgcacttcgctaagctgctgacaactaaaacaaccttggacaaccaggatggaaatttttacggggagtttggggtgctttacgacgagctggctaaaattccaactctctacaataaggttagagattatctctctcaaaagcccttttctaccgaaaagtataagctcaacttcggcaatccgacccttctcaatgggtgggacctgaacaaagagaaagataactttggggttatacttcagaaggatggatgctattacttggcgcttcttgataaggctcataaaaaagttttcgacaacgcccctaacactggtaagaacgtctaccaaaagatggtctacaaactgttgcccggccccaacaaaatgcttcctaaagtgtttttcgcaaaatcgaatctcgactattataatccatctgccgagctccttgacaaatatgctaaggggacccataaaaagggtgataatttcaacctgaaggactgccacgcgcttatcgactttttcaaagccgggataaataagcatccggagtggcaacattttggttttaaattttcgccaacgtcgtcctatcgcgacctttccgatttctatagggaagttgaacctcaggggtaccaggtcaaatttgttgacattaatgcggactacattgatgaattggtggagcaagggaagctctacctctttcaaatatataacaaagatttctcgccaaaagcgcatggtaaaccgaatcttcataccttgtactttaaagcacttttttcagaagataacttggcggacccgatctacaagctgaatggggaagctcagatcttctacaggaaagcttcgttggacatgaacgagactaccatacatcgcgcgggagaggtgcttgagaacaaaaatcccgacaacccgaaaaagcggcaattcgtttacgacatcatcaaagacaaacggtacacgcaggacaaatttatgctccacgtccccattaccatgaattttggagtccaaggcatgaccattaaggaattcaacaaaaaggtcaaccaaagtattcagcaatacgatgaagtcaatgtcataggcatagatcggggagaaaggcatctgttgtatcttaccgtgattaactctaagggtgaaatactggagcaacggtcacttaacgatataaccacggcgtccgcgaacggtacacaagtgaccactccctaccacaaaatattggataaaagggagatagaacgcttgaatgcccgcgttggctggggtgagattgagaccatcaaagagcttaaatcgggatatttgtctcacgtcgttcatcaaattaaccaactcatgcttaagtacaatgcaatcgttgtgctcgaggacctgaactttggtttcaaaagagggaggttcaaggtggaaaaacaaatttaccagaactttgaaaacgcgcttatcaagaaattgaatcaccttgttttgaaagataaggcagatgacgaaatcgggtcgtataaaaatgcactccagttgacaaataatttcacggatttgaagtcgatcggcaagcaaacagggttcctcttttatgtgccagcgtggaatacatcaaaaattgatccggagacgggatttgtcgacttgctgaagcctaggtatgagaacattgcccaatctcaggcctttttcggcaaattcgataaaatatgctacaacacagacaaaggttattttgaatttcacattgattacgccaaatttacagataaggcgaaaaacagcagacagaaatgggctatctgttctcatggggacaaacgctatgtctacgataagacggctaatcaaaataaaggcgccgcaaaaggtattaatgtgaatgatgagctgaaaagcttgtttgcccgctaccatatcaatgataaacaaccaaacttggtgatggacatatgccagaacaatgacaaagaattccacaagtcactcatgtgcctgcttaaaacccttttggcgctgcggtatagcaatgcatctagcgatgaagactttattttgagtcccgtggccaacgacgagggcgtgttttttaattcagccttggcggacgatacgcagccccagaatgcggacgcaaacggcgcgtaccacattgcactgaagggactgtggcttctgaacgagctgaaaaatagcgacgacctgaataaagtcaagttggccattgacaatcaaacctggttgaatttcgctcaaaataga

SEQ ID NO: 5 - DNA, 4367 bp, Artificial Sequence
  Codon optimized fusion protein
atgtccagcgagaccggccccgtggcggtggaccccaccctgcgcaggcgcatcgagccgcacgagttcgaggtgttcttcgaccccagggagctccgcaaggagacctgcctcctgtacgagatcaactggggcggcaggcactccatctggaggcacacgagccagaacaccaacaagcacgtcgaggtgaacttcatcgagaagttcaccacggagaggtacttctgcccgaacacgcgctgctccatcacgtggttcctctcgtggagcccatgcggcgagtgctccagggcgatcacggagttcctcagccgctacccgcacgtgaccctgttcatctacatcgctaggctctaccaccacgcggaccccaggaacaggcagggcctcagggacctgatctccagcggcgtcacgatccagatcatgaccgagcaggagtccggctactgctggaggaacttcgtgaactactccccgagcaacgaggcccactggccccgctacccgcacctctgggtccgcctctacgtgctcgagctgtactgcatcatcctcggcctgccgccctgcctcaacatcctgaggcgcaagcagccccagctgacgttcttcaccatcgccctgcagagctgccactaccagaggctcccgccccacatcctgtgggcgaccgggctcaaggggggcgggggctcaggcgggggcgggagcggcggcgggggctctgggggcggcggcagcggcgggggcggcagcgggggcggcgggtcgatgagcaagctggagaagttcacgaactgctactccctcagcaagaccctgaggttcaaggcgatcccggtcggcaagacccaggagaacatcgacaacaagcggctgctggtggaggacgagaagagggctgaggactacaagggcgtgaagaagctcctggaccgctactacctgtccttcatcaacgacgtgctccacagcatcaagctcaagaacctgaacaactacatcagcctcttcaggaagaagacgcgcaccgagaaggagaacaaggagctcgagaacctggagatcaacctgaggaaggagatcgccaaggcgttcaagggcaacgagggctacaagtccctcttcaagaaggacatcatcgagacgatcctcccggagttcctggacgacaaggacgagatcgccctggtcaactccttcaacggcttcaccacggcgttcaccggcttcttcgacaaccgcgagaacatgttcagcgaggaggccaagtccacgagcatcgcgttcaggtgcatcaacgagaacctcacccgctacatctccaacatggacatcttcgagaaggtcgacgcgatcttcgacaagcacgaggtgcaggagatcaaggagaagatcctgaacagcgactacgacgtcgaggacttcttcgagggcgagttcttcaacttcgtcctcacgcaggagggcatcgacgtgtacaacgccatcatcggtggcttcgtgaccgagtccggcgagaagatcaagggcctgaacgagtacatcaacctctacaaccagaagaccaagcagaagctgccgaagttcaagcccctgtacaagcaggtgctctccgacagggagtccctcagcttctacggcgagggctacacgagcgacgaggaggtcctggaggtgttccgcaacaccctcaacaagaacagcgagatcttctccagcatcaagaagctcgagaagctgttcaagaacttcgacgagtactccagcgccggcatcttcgtcaagaacggcccggcgatctccacgatcagcaaggacatcttcggcgagtggaacgtgatccgcgacaagtggaacgccgagtacgacgacatccacctcaagaagaaggcggtggtcaccgagaagtacgaggacgacaggcgcaagtccttcaagaagatcggctccttcagcctcgagcagctgcaggagtacgccgacgcggacctgagcgtggtcgagaagctcaaggagatcatcatccagaaggtcgacgagatctacaaggtgtacggctccagcgagaagctcttcgacgcggacttcgtcctcgagaagtccctgaagaagaacgacgccgtggtcgcgatcatgaaggacctcctggactccgtgaagagcttcgagaattacatcaaggccttcttcggcgagggcaaggagacgaacagggacgagtccttctacggcgacttcgtcctggcctacgacatcctcctgaaggtggaccacatctacgacgcgatccgcaactacgtgacccagaagccgtacagcaaggacaagttcaagctctacttccagaacccccagttcatgggcggctgggacaaggacaaggagacggactacagggcgaccatcctgcgctacggcagcaagtactacctcgccatcatggacaagaagtacgcgaagtgcctgcagaagatcgacaaggacgacgtcaacggcaactacgagaagatcaactacaagctcctgccgggccccaacaagatgctcccgaaggtgttcttctccaagaagtggatggcctactacaaccccagcgaggacatccagaagatctacaagaacggcacgttcaagaagggcgacatgttcaacctgaacgactgccacaagctcatcgacttcttcaaggactccatcagccgctacccgaagtggtccaacgcctacgacttcaacttcagcgagaccgagaagtacaaggacatcgcgggcttctaccgcgaggtcgaggagcagggctacaaggtgtccttcgagtccgccagcaagaaggaggtcgacaagctggtggaggagggcaagctctacatgttccagatctacaacaaggacttctccgacaagagccacggcacgcccaacctgcacaccatgtacttcaagctcctgttcgacgagaacaaccacggccagatcaggctgtccggcggcgccgagctcttcatgaggagggcgagcctgaagaaggaggagctggtggtccaccccgctaacagcccaatcgcgaacaagaacccggacaaccccaagaagaccacgaccctgtcctacgacgtgtacaaggacaagaggttcagcgaggaccagtacgagctccacatcccgatcgcgatcaacaagtgccccaagaacatcttcaagatcaacaccgaggtccgcgtgctcctgaagcacgacgacaacccctacgtgatcggcatcgctaggggcgagaggaacctcctgtacatcgtggtcgtggacggcaagggcaacatcgtggagcagtactccctcaacgagatcatcaacaacttcaacggcatcaggatcaagacggactaccacagcctcctggacaagaaggagaaggagaggttcgaggcccgccagaactggacctccatcgagaacatcaaggagctgaaggcgggctacatcagccaggtcgtgcacaagatctgcgagctcgtcgagaagtacgacgccgtgatcgccctcgcggacctgaactccggcttcaagaacagccgcgtcaaggtggagaagcaggtctaccagaagttcgagaagatgctcatcgacaagctgaactacatggtggacaagaagtccaacccctgcgctacgggcggcgcgctgaagggctaccagatcaccaacaagttcgagagcttcaagtccatgagcactcagaacggcttcatcttctacatcccggcgtggctcacgtccaagatcgaccccagcaccggcttcgtcaacctcctgaagacgaagtacacctccatcgccgacagcaagaagttcatctccagcttcgaccgcatcatgtatgtgccggaggaggacctgttcgagttcgccctcgactacaagaacttctcccgcacggacgcggactacatcaagaagtggaagctgtacagctacggcaaccgcatccgcatcttcaggaaccccaagaagaacaacgtcttcgactgggaggaggtgtgcctgacctccgcgtacaaggagctcttcaacaagtacggcatcaactaccagcagggcgacatcagggctctcctgtgcgagcagagcgacaaggccttctactccagcttcatggcgctgatgtccctcatgctgcagatgaggaactcgatcaccggcaggacggacgtggccttcctcatctccccggtgaagaacagcgacggcatcttctacgactccaggaactacgaggcccaggagaacgcgatcctcccaaagaacgcggacgccaacggcgcctacaacatcgccaggaaggtcctctgggctatcggcca

SEQ ID NO: 6 - protein, 1455 aa, Artificial Sequence
  Fusion protein
MSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQLTFFTIALQSCHYQRLPPHILWATGLKGGGGSGGGGSGGGGSGGGGSGGGGSGGGGSMSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIARGERNLLYIVVVDGKGNIVEQYSLNEIINNFNGIRIKTDYHSLLDKKEKERFEARQNWTSIENIKELKAGYISQVVHKICELVEKYDAVIALADLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVAFLISPVKNSDGIFYDSRNYEAQENAILPKNADANGAYNIARKVLWAIG

SEQ ID NO: 7 - DNA, 249 bp, Artificial Sequence
  Codon Optimized
acgaacctgtccgacatcatcgagaaggagaccggcaagcagctcgtgatccaggagagcatcctcatgctgccggaggaggtcgaggaggtcatcggcaacaagcccgagtccgacatcctcgtccacacggcctacgacgagtccaccgacgagaacgtgatgctcctgacctcggacgctcccgagtacaagccatgggccctggtcatccaggacagcaacggcgagaacaagatcaagatgctc

SEQ ID NO: 8 - protein, 83 aa, Bacillus subtilis phage PBSX
TNLSDIIEKETGKQLVIQESILMLPEEVEEVIGNKPESDILVHTAYDESTDENVMLLTSDAPEYKPWALVIQDSNGENKIKML

SEQ ID NO: 9 - DNA, 6882 bp, Artificial Sequence
  Codon optimized fusion
gaattcattatgtggtctaggtaggttctatatataagaaaacttgaaatgttctaaaaaaaaattcaagcccatgcatgattgaagcaaacggtatagcaacggtgttaacctgatctagtgatctcttgcaatccttaacggccacctaccgcaggtagcaaacggcgtccccctcctcgatatctccgcggcgacctctggctttttccgcggaattgcgcggtggggacggattccacgagaccgcgacgcaaccgcctctcgccgctgggccccacaccgctcggtgccgtagcctcacgggactctttctccctcctcccccgttataaattggcttcatcccctccttgcctcatccatccaaatcccagtccccaatcccatcccttcgtaggagaaattcatcgaagctaagcgaatcctcgcgatcctctcaaggtactgcgagttttcgatccccctctcgacccctcgtatgtttgtgtttgtcgtagcgtttgattaggtatgctttccctgtttgtgttcgtcgtagcgtttgattaggtatgctttccctgttcgtgttcatcgtagtgtttgattaggtcgtgtgaggcgatggcctgctcgcgtccttcgatctgtagtcgatttgcgggtcgtggtgtagatctgcgggctgtgatgaagttatttggtgtgatctgctcgcctgattctgcgggttggctcgagtagatatgatggttggaccggttggttcgtttaccgcgctagggttgggctgggatgatgttgcatgcgccgttgcgcgtgatcccgcagcaggacttgcgtttgattgccagatctcgttacgattatgtgatttggtttggactttttagatctgtagcttctgcttatgtgccagatgcgcctactgctcatatgcctgatgataatcataaatggctgtggaactaactagttgattgcggagtcatgtatcagctacaggtgtagggactagctacaggtgtagggacttgcgtctaattgtttggtcctttactcatgttgcaattatgcaatttagtttagattgtttgttccactcatctaggctgtaaaagggacactgcttagattgctgtttaatctttttagtagattatattatattggtaacttattacccctattacatgccatacgtgacttctgctcatgcctgatgataatcatagatcactgtggaattaattagttgattgttgaatcatgtttcatgtacataccacggcacaattgcttagttccttaacaaatgcaaattttactgatccatgtatgatttgcgtggttctctaatgtgaaatactatagctacttgttagtaagaatcaggttcgtatgcttaatgctgtatgtgccttctgctcatgcctgatgataatcatatatcactggaattaattagttgatcgtttaatcatatatcaagtacataccatgccacaatttttagtcacttaacccatgcagattgaactggtccctgcatgttttgctaaattgttctattctgattagaccatatatcatgtatttttttttggtaatggttctcttattttaaatgctatatagttctggtacttgttagaaagatctgcttcatagtttagttgcctatccctcgaattaggatgctgagcagctgatcctatagctttgtttcatgtatcaattcttttgtgttcaacagtcagtttttgttagattcattgtaacttatggtcgcttactcttctggtcctcaatgcttgcagggatcccctaaatagaccatgccgaagaagaagcgcaaggtcatgtccagcgagaccggccccgtggcggtggaccccaccctgcgcaggcgcatcgagccgcacgagttcgaggtgttcttcgaccccagggagctccgcaaggagacctgcctcctgtacgagatcaactggggcggcaggcactccatctggaggcacacgagccagaacaccaacaagcacgtcgaggtgaacttcatcgagaagttcaccacggagaggtacttctgcccgaacacgcgctgctccatcacgtggttcctctcgtggagcccatgcggcgagtgctccagggcgatcacggagttcctcagccgctacccgcacgtgaccctgttcatctacatcgctaggctctaccaccacgcggaccccaggaacaggcagggcctcagggacctgatctccagcggcgtcacgatccagatcatgaccgagcaggagtccggctactgctggaggaacttcgtgaactactccccgagcaacgaggcccactggccccgctacccgcacctctgggtccgcctctacgtgctcgagctgtactgcatcatcctcggcctgccgccctgcctcaacatcctgaggcgcaagcagccccagctgacgttcttcaccatcgccctgcagagctgccactaccagaggctcccgccccacatcctgtgggcgaccgggctcaaggggggcgggggctcaggcgggggcgggagcggcggcgggggctctgggggcggcggcagcggcgggggcggcagcgggggcggcgggtcgatgagcaagctggagaagttcacgaactgctactccctcagcaagaccctgaggttcaaggcgatcccggtcggcaagacccaggagaacatcgacaacaagcggctgctggtggaggacgagaagagggctgaggactacaagggcgtgaagaagctcctggaccgctactacctgtccttcatcaacgacgtgctccacagcatcaagctcaagaacctgaacaactacatcagcctcttcaggaagaagacgcgcaccgagaaggagaacaaggagctcgagaacctggagatcaacctgaggaaggagatcgccaaggcgttcaagggcaacgagggctacaagtccctcttcaagaaggacatcatcgagacgatcctcccggagttcctggacgacaaggacgagatcgccctggtcaactccttcaacggcttcaccacggcgttcaccggcttcttcgacaaccgcgagaacatgttcagcgaggaggccaagtccacgagcatcgcgttcaggtgcatcaacgagaacctcacccgctacatctccaacatggacatcttcgagaaggtcgacgcgatcttcgacaagcacgaggtgcaggagatcaaggagaagatcctgaacagcgactacgacgtcgaggacttcttcgagggcgagttcttcaacttcgtcctcacgcaggagggcatcgacgtgtacaacgccatcatcggtggcttcgtgaccgagtccggcgagaagatcaagggcctgaacgagtacatcaacctctacaaccagaagaccaagcagaagctgccgaagttcaagcccctgtacaagcaggtgctctccgacagggagtccctcagcttctacggcgagggctacacgagcgacgaggaggtcctggaggtgttccgcaacaccctcaacaagaacagcgagatcttctccagcatcaagaagctcgagaagctgttcaagaacttcgacgagtactccagcgccggcatcttcgtcaagaacggcccggcgatctccacgatcagcaaggacatcttcggcgagtggaacgtgatccgcgacaagtggaacgccgagtacgacgacatccacctcaagaagaaggcggtggtcaccgagaagtacgaggacgacaggcgcaagtccttcaagaagatcggctccttcagcctcgagcagctgcaggagtacgccgacgcggacctgagcgtggtcgagaagctcaaggagatcatcatccagaaggtcgacgagatctacaaggtgtacggctccagcgagaagctcttcgacgcggacttcgtcctcgagaagtccctgaagaagaacgacgccgtggtcgcgatcatgaaggacctcctggactccgtgaagagcttcgagaattacatcaaggccttcttcggcgagggcaaggagacgaacagggacgagtccttctacggcgacttcgtcctggcctacgacatcctcctgaaggtggaccacatctacgacgcgatccgcaactacgtgacccagaagccgtacagcaaggacaagttcaagctctacttccagaacccccagttcatgggcggctgggacaaggacaaggagacggactacagggcgaccatcctgcgctacggcagcaagtactacctcgccatcatggacaagaagtacgcgaagtgcctgcagaagatcgacaaggacgacgtcaacggcaactacgagaagatcaactacaagctcctgccgggccccaacaagatgctcccgaaggtgttcttctccaagaagtggatggcctactacaaccccagcgaggacatccagaagatctacaagaacggcacgttcaagaagggcgacatgttcaacctgaacgactgccacaagctcatcgacttcttcaaggactccatcagccgctacccgaagtggtccaacgcctacgacttcaacttcagcgagaccgagaagtacaaggacatcgcgggcttctaccgcgaggtcgaggagcagggctacaaggtgtccttcgagtccgccagcaagaaggaggtcgacaagctggtggaggagggcaagctctacatgttccagatctacaacaaggacttctccgacaagagccacggcacgcccaacctgcacaccatgtacttcaagctcctgttcgacgagaacaaccacggccagatcaggctgtccggcggcgccgagctcttcatgaggagggcgagcctgaagaaggaggagctggtggtccaccccgctaacagcccaatcgcgaacaagaacccggacaaccccaagaagaccacgaccctgtcctacgacgtgtacaaggacaagaggttcagcgaggaccagtacgagctccacatcccgatcgcgatcaacaagtgccccaagaacatcttcaagatcaacaccgaggtccgcgtgctcctgaagcacgacgacaacccctacgtgatcggcatcgctaggggcgagaggaacctcctgtacatcgtggtcgtggacggcaagggcaacatcgtggagcagtactccctcaacgagatcatcaacaacttcaacggcatcaggatcaagacggactaccacagcctcctggacaagaaggagaaggagaggttcgaggcccgccagaactggacctccatcgagaacatcaaggagctgaaggcgggctacatcagccaggtcgtgcacaagatctgcgagctcgtcgagaagtacgacgccgtgatcgccctcgcggacctgaactccggcttcaagaacagccgcgtcaaggtggagaagcaggtctaccagaagttcgagaagatgctcatcgacaagctgaactacatggtggacaagaagtccaacccctgcgctacgggcggcgcgctgaagggctaccagatcaccaacaagttcgagagcttcaagtccatgagcactcagaacggcttcatcttctacatcccggcgtggctcacgtccaagatcgaccccagcaccggcttcgtcaacctcctgaagacgaagtacacctccatcgccgacagcaagaagttcatctccagcttcgaccgcatcatgtatgtgccggaggaggacctgttcgagttcgccctcgactacaagaacttctcccgcacggacgcggactacatcaagaagtggaagctgtacagctacggcaaccgcatccgcatcttcaggaaccccaagaagaacaacgtcttcgactgggaggaggtgtgcctgacctccgcgtacaaggagctcttcaacaagtacggcatcaactaccagcagggcgacatcagggctctcctgtgcgagcagagcgacaaggccttctactccagcttcatggcgctgatgtccctcatgctgcagatgaggaactcgatcaccggcaggacggacgtggccttcctcatctccccggtgaagaacagcgacggcatcttctacgactccaggaactacgaggcccaggagaacgcgatcctcccaaagaacgcggacgccaacggcgcctacaacatcgccaggaaggtcctctgggctatcggccagttcaagaaggcggaggacgagaagctggacaaggtgaagatcgccatcagcaacaaggagtggctcgagtacgcccagacctcggtcaagcacggcagcccgaagaagaagcgcaaggtgtccggcggcagcacgaacctgtccgacatcatcgagaaggagaccggcaagcagctcgtgatccaggagagcatcctcatgctgccggaggaggtcgaggaggtcatcggcaacaagcccgagtccgacatcctcgtccacacggcctacgacgagtccaccgacgagaacgtgatgctcctgacctcggacgctcccgagtacaagccatgggccctggtcatccaggacagcaacggcgagaacaagatcaagatgctctccggcggcagcccgaagaagaagcgcaaagtgtgagatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatc

SEQ ID NO: 10 - DNA, 90 bp, Artificial Sequence
  Synthetic
gggggcgggggctcaggcgggggcgggagcggcggcgggggctctgggggcggcggcagcggcgggggcggcagcgggggcggcgggtcg

SEQ ID NO: 11 - protein, 30 aa, Artificial Sequence
  Synthetic
GGGGSGGGGSGGGGSGGGGSGGGGSGGGGS

SEQ ID NO: 12 - protein, 18 aa, Artificial Sequence
  Synthetic
GGSTGGGSGGGSGGGSSG

SEQ ID NO: 13 - protein, 15 aa, Artificial Sequence
  Synthetic
GGGGSGGGGSGGGGS

SEQ ID NO: 14 - DNA, 4842 bp, Artificial Sequence
  Codon optimized fusion
atgccgaagaagaagcgcaaggtcatgtccagcgagaccggccccgtggcggtggaccccaccctgcgcaggcgcatcgagccgcacgagttcgaggtgttcttcgaccccagggagctccgcaaggagacctgcctcctgtacgagatcaactggggcggcaggcactccatctggaggcacacgagccagaacaccaacaagcacgtcgaggtgaacttcatcgagaagttcaccacggagaggtacttctgcccgaacacgcgctgctccatcacgtggttcctctcgtggagcccatgcggcgagtgctccagggcgatcacggagttcctcagccgctacccgcacgtgaccctgttcatctacatcgctaggctctaccaccacgcggaccccaggaacaggcagggcctcagggacctgatctccagcggcgtcacgatccagatcatgaccgagcaggagtccggctactgctggaggaacttcgtgaactactccccgagcaacgaggcccactggccccgctacccgcacctctgggtccgcctctacgtgctcgagctgtactgcatcatcctcggcctgccgccctgcctcaacatcctgaggcgcaagcagccccagctgacgttcttcaccatcgccctgcagagctgccactaccagaggctcccgccccacatcctgtgggcgaccgggctcaagtcgggcagcgagacccccggcacctccgagtcggctaccccagagtccatgagcaagctggagaagttcacgaactgctactccctcagcaagaccctgaggttcaaggcgatcccggtcggcaagacccaggagaacatcgacaacaagcggctgctggtggaggacgagaagagggctgaggactacaagggcgtgaagaagctcctggaccgctactacctgtccttcatcaacgacgtgctccacagcatcaagctcaagaacctgaacaactacatcagcctcttcaggaagaagacgcgcaccgagaaggagaacaaggagctcgagaacctggagatcaacctgaggaaggagatcgccaaggcgttcaagggcaacgagggctacaagtccctcttcaagaaggacatcatcgagacgatcctcccggagttcctggacgacaaggacgagatcgccctggtcaactccttcaacggcttcaccacggcgttcaccggcttcttcgacaaccgcgagaacatgttcagcgaggaggccaagtccacgagcatcgcgttcaggtgcatcaacgagaacctcacccgctacatctccaacatggacatcttcgagaaggtcgacgcgatcttcgacaagcacgaggtgcaggagatcaaggagaagatcctgaacagcgactacgacgtcgaggacttcttcgagggcgagttcttcaacttcgtcctcacgcaggagggcatcgacgtgtacaacgccatcatcggtggcttcgtgaccgagtccggcgagaagatcaagggcctgaacgagtacatcaacctctacaaccagaagaccaagcagaagctgccgaagttcaagcccctgtacaagcaggtgctctccgacagggagtccctcagcttctacggcgagggctacacgagcgacgaggaggtcctggaggtgttccgcaacaccctcaacaagaacagcgagatcttctccagcatcaagaagctcgagaagctgttcaagaacttcgacgagtactccagcgccggcatcttcgtcaagaacggcccggcgatctccacgatcagcaaggacatcttcggcgagtggaacgtgatccgcgacaagtggaacgccgagtacgacgacatccacctcaagaagaaggcggtggtcaccgagaagtacgaggacgacaggcgcaagtccttcaagaagatcggctccttcagcctcgagcagctgcaggagtacgccgacgcggacctgagcgtggtcgagaagctcaaggagatcatcatccagaaggtcgacgagatctacaaggtgtacggctccagcgagaagctcttcgacgcggacttcgtcctcgagaagtccctgaagaagaacgacgccgtggtcgcgatcatgaaggacctcctggactccgtgaagagcttcgagaattacatcaaggccttcttcggcgagggcaaggagacgaacagggacgagtccttctacggcgacttcgtcctggcctacgacatcctcctgaaggtggaccacatctacgacgcgatccgcaactacgtgacccagaagccgtacagcaaggacaagttcaagctctacttccagaacccccagttcatgggcggctgggacaaggacaaggagacggactacagggcgaccatcctgcgctacggcagcaagtactacctcgccatcatggacaagaagtacgcgaagtgcctgcagaagatcgacaaggacgacgtcaacggcaactacgagaagatcaactacaagctcctgccgggccccaacaagatgctcccgaaggtgttcttctccaagaagtggatggcctactacaaccccagcgaggacatccagaagatctacaagaacggcacgttcaagaagggcgacatgttcaacctgaacgactgccacaagctcatcgacttcttcaaggactccatcagccgctacccgaagtggtccaacgcctacgacttcaacttcagcgagaccgagaagtacaaggacatcgcgggcttctaccgcgaggtcgaggagcagggctacaaggtgtccttcgagtccgccagcaagaaggaggtcgacaagctggtggaggagggcaagctctacatgttccagatctacaacaaggacttctccgacaagagccacggcacgcccaacctgcacaccatgtacttcaagctcctgttcgacgagaacaaccacggccagatcaggctgtccggcggcgccgagctcttcatgaggagggcgagcctgaagaaggaggagctggtggtccaccccgctaacagcccaatcgcgaacaagaacccggacaaccccaagaagaccacgaccctgtcctacgacgtgtacaaggacaagaggttcagcgaggaccagtacgagctccacatcccgatcgcgatcaacaagtgccccaagaacatcttcaagatcaacaccgaggtccgcgtgctcctgaagcacgacgacaacccctacgtgatcggcatcgctaggggcgagaggaacctcctgtacatcgtggtcgtggacggcaagggcaacatcgtggagcagtactccctcaacgagatcatcaacaacttcaacggcatcaggatcaagacggactaccacagcctcctggacaagaaggagaaggagaggttcgaggcccgccagaactggacctccatcgagaacatcaaggagctgaaggcgggctacatcagccaggtcgtgcacaagatctgcgagctcgtcgagaagtacgacgccgtgatcgccctcgcggacctgaactccggcttcaagaacagccgcgtcaaggtggagaagcaggtctaccagaagttcgagaagatgctcatcgacaagctgaactacatggtggacaagaagtccaacccctgcgctacgggcggcgcgctgaagggctaccagatcaccaacaagttcgagagcttcaagtccatgagcactcagaacggcttcatcttctacatcccggcgtggctcacgtccaagatcgaccccagcaccggcttcgtcaacctcctgaagacgaagtacacctccatcgccgacagcaagaagttcatctccagcttcgaccgcatcatgtatgtgccggaggaggacctgttcgagttcgccctcgactacaagaacttctcccgcacggacgcggactacatcaagaagtggaagctgtacagctacggcaaccgcatccgcatcttcaggaaccccaagaagaacaacgtcttcgactgggaggaggtgtgcctgacctccgcgtacaaggagctcttcaacaagtacggcatcaactaccagcagggcgacatcagggctctcctgtgcgagcagagcgacaaggccttctactccagcttcatggcgctgatgtccctcatgctgcagatgaggaactcgatcaccggcaggacggacgtggccttcctcatctccccggtgaagaacagcgacggcatcttctacgactccaggaactacgaggcccaggagaacgcgatcctcccaaagaacgcggacgccaacggcgcctacaacatcgccaggaaggtcctctgggctatcggccagttcaagaaggcggaggacgagaagctggacaaggtgaagatcgccatcagcaacaaggagtggctcgagtacgcccagacctcggtcaagcacggcagcccgaagaagaagcgcaaggtgggagggtcgacaggaggcggttctggcggaggttcaggtggaggctcgagtggtacgaacctgtccgacatcatcgagaaggagaccggcaagcagctcgtgatccaggagagcatcctcatgctgccggaggaggtcgaggaggtcatcggcaacaagcccgagtccgacatcctcgtccacacggcctacgacgagtccaccgacgagaacgtgatgctcctgacctcggacgctcccgagtacaagccatgggccctggtcatccaggacagcaacggcgagaacaagatcaagatgctcggtggaggcggttcaggcggaggtggctctggcggtggcggatcgccgaagaagaagcgcaaagtgtga

SEQ ID NO: 15 - protein, 1613 aa, Artificial Sequence
  Synthetic
MPKKKRKVMSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQLTFFTIALQSCHYQRLPPHILWATGLKSGSETPGTSESATPESMSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIARGERNLLYIVVVDGKGNIVEQYSLNEIINNFNGIRIKTDYHSLLDKKEKERFEARQNWTSIENIKELKAGYISQVVHKICELVEKYDAVIALADLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVAFLISPVKNSDGIFYDSRNYEAQENAILPKNADANGAYNIARKVLWAIGQFKKAEDEKLDKVKIAISNKEWLEYAQTSVKHGSPKKKRKVGGSTGGGSGGGSGGGSSGTNLSDIIEKETGKQLVIQESILMLPEEVEEVIGNKPESDILVHTAYDESTDENVMLLTSDAPEYKPWALVIQDSNGENKIKMLGGGGSGGGGSGGGGSPKKKRKV

SEQ ID NO: 16 - DNA, 5145 bp, Artificial Sequence
  Synthetic
atgccgaagaagaagcgcaaggtcatgtccagcgagaccggccccgtggcggtggaccccaccctgcgcaggcgcatcgagccgcacgagttcgaggtgttcttcgaccccagggagctccgcaaggagacctgcctcctgtacgagatcaactggggcggcaggcactccatctggaggcacacgagccagaacaccaacaagcacgtcgaggtgaacttcatcgagaagttcaccacggagaggtacttctgcccgaacacgcgctgctccatcacgtggttcctctcgtggagcccatgcggcgagtgctccagggcgatcacggagttcctcagccgctacccgcacgtgaccctgttcatctacatcgctaggctctaccaccacgcggaccccaggaacaggcagggcctcagggacctgatctccagcggcgtcacgatccagatcatgaccgagcaggagtccggctactgctggaggaacttcgtgaactactccccgagcaacgaggcccactggccccgctacccgcacctctgggtccgcctctacgtgctcgagctgtactgcatcatcctcggcctgccgccctgcctcaacatcctgaggcgcaagcagccccagctgacgttcttcaccatcgccctgcagagctgccactaccagaggctcccgccccacatcctgtgggcgaccgggctcaaggggggcgggggctcaggcgggggcgggagcggcggcgggggctctgggggcggcggcagcggcgggggcggcagcgggggcggcgggtcgatgagcaagctggagaagttcacgaactgctactccctcagcaagaccctgaggttcaaggcgatcccggtcggcaagacccaggagaacatcgacaacaagcggctgctggtggaggacgagaagagggctgaggactacaagggcgtgaagaagctcctggaccgctactacctgtccttcatcaacgacgtgctccacagcatcaagctcaagaacctgaacaactacatcagcctcttcaggaagaagacgcgcaccgagaaggagaacaaggagctcgagaacctggagatcaacctgaggaaggagatcgccaaggcgttcaagggcaacgagggctacaagtccctcttcaagaaggacatcatcgagacgatcctcccggagttcctggacgacaaggacgagatcgccctggtcaactccttcaacggcttcaccacggcgttcaccggcttcttcgacaaccgcgagaacatgttcagcgaggaggccaagtccacgagcatcgcgttcaggtgcatcaacgagaacctcacccgctacatctccaacatggacatcttcgagaaggtcgacgcgatcttcgacaagcacgaggtgcaggagatcaaggagaagatcctgaacagcgactacgacgtcgaggacttcttcgagggcgagttcttcaacttcgtcctcacgcaggagggcatcgacgtgtacaacgccatcatcggtggcttcgtgaccgagtccggcgagaagatcaagggcctgaacgagtacatcaacctctacaaccagaagaccaagcagaagctgccgaagttcaagcccctgtacaagcaggtgctctccgacagggagtccctcagcttctacggcgagggctacacgagcgacgaggaggtcctggaggtgttccgcaacaccctcaacaagaacagcgagatcttctccagcatcaagaagctcgagaagctgttcaagaacttcgacgagtactccagcgccggcatcttcgtcaagaacggcccggcgatctccacgatcagcaaggacatcttcggcgagtggaacgtgatccgcgacaagtggaacgccgagtacgacgacatccacctcaagaagaaggcggtggtcaccgagaagtacgaggacgacaggcgcaagtccttcaagaagatcggctccttcagcctcgagcagctgcaggagtacgccgacgcggacctgagcgtggtcgagaagctcaaggagatcatcatccagaaggtcgacgagatctacaaggtgtacggctccagcgagaagctcttcgacgcggacttcgtcctcgagaagtccctgaagaagaacgacgccgtggtcgcgatcatgaaggacctcctggactccgtgaagagcttcgagaattacatcaaggccttcttcggcgagggcaaggagacgaacagggacgagtccttctacggcgacttcgtcctggcctacgacatcctcctgaaggtggaccacatctacgacgcgatccgcaactacgtgacccagaagccgtacagcaaggacaagttcaagctctacttccagaacccccagttcatgggcggctgggacaaggacaaggagacggactacagggcgaccatcctgcgctacggcagcaagtactacctcgccatcatggacaagaagtacgcgaagtgcctgcagaagatcgacaaggacgacgtcaacggcaactacgagaagatcaactacaagctcctgccgggccccaacaagatgctcccgaaggtgttcttctccaagaagtggatggcctactacaaccccagcgaggacatccagaagatctacaagaacggcacgttcaagaagggcgacatgttcaacctgaacgactgccacaagctcatcgacttcttcaaggactccatcagccgctacccgaagtggtccaacgcctacgacttcaacttcagcgagaccgagaagtacaaggacatcgcgggcttctaccgcgaggtcgaggagcagggctacaaggtgtccttcgagtccgccagcaagaaggaggtcgacaagctggtggaggagggcaagctctacatgttccagatctacaacaaggacttctccgacaagagccacggcacgcccaacctgcacaccatgtacttcaagctcctgttcgacgagaacaaccacggccagatcaggctgtccggcggcgccgagctcttcatgaggagggcgagcctgaagaaggaggagctggtggtccaccccgctaacagcccaatcgcgaacaagaacccggacaaccccaagaagaccacgaccctgtcctacgacgtgtacaaggacaagaggttcagcgaggaccagtacgagctccacatcccgatcgcgatcaacaagtgccccaagaacatcttcaagatcaacaccgaggtccgcgtgctcctgaagcacgacgacaacccctacgtgatcggcatcgctaggggcgagaggaacctcctgtacatcgtggtcgtggacggcaagggcaacatcgtggagcagtactccctcaacgagatcatcaacaacttcaacggcatcaggatcaagacggactaccacagcctcctggacaagaaggagaaggagaggttcgaggcccgccagaactggacctccatcgagaacatcaaggagctgaaggcgggctacatcagccaggtcgtgcacaagatctgcgagctcgtcgagaagtacgacgccgtgatcgccctcgcggacctgaactccggcttcaagaacagccgcgtcaaggtggagaagcaggtctaccagaagttcgagaagatgctcatcgacaagctgaactacatggtggacaagaagtccaacccctgcgctacgggcggcgcgctgaagggctaccagatcaccaacaagttcgagagcttcaagtccatgagcactcagaacggcttcatcttctacatcccggcgtggctcacgtccaagatcgaccccagcaccggcttcgtcaacctcctgaagacgaagtacacctccatcgccgacagcaagaagttcatctccagcttcgaccgcatcatgtatgtgccggaggaggacctgttcgagttcgccctcgactacaagaacttctcccgcacggacgcggactacatcaagaagtggaagctgtacagctacggcaaccgcatccgcatcttcaggaaccccaagaagaacaacgtcttcgactgggaggaggtgtgcctgacctccgcgtacaaggagctcttcaacaagtacggcatcaactaccagcagggcgacatcagggctctcctgtgcgagcagagcgacaaggccttctactccagcttcatggcgctgatgtccctcatgctgcagatgaggaactcgatcaccggcaggacggacgtggccttcctcatctccccggtgaagaacagcgacggcatcttctacgactccaggaactacgaggcccaggagaacgcgatcctcccaaagaacgcggacgccaacggcgcctacaacatcgccaggaaggtcctctgggctatcggccagttcaagaaggcggaggacgagaagctggacaaggtgaagatcgccatcagcaacaaggagtggctcgagtacgcccagacctcggtcaagcacggcagcccgaagaagaagcgcaaggtgggagggtcgacaggaggcggttctggcggaggttcaggtggaggctcgagtggtacgaacctgtccgacatcatcgagaaggagaccggcaagcagctcgtgatccaggagagcatcctcatgctgccggaggaggtcgaggaggtcatcggcaacaagcccgagtccgacatcctcgtccacacggcctacgacgagtccaccgacgagaacgtgatgctcctgacctcggacgctcccgagtacaagccatgggccctggtcatccaggacagcaacggcgagaacaagatcaagatgctcggtggaggcggttcaggcggaggtggctctggcggtggcggatcgacgaacctgtccgacatcatcgagaaggagaccggcaagcagctcgtgatccaggagagcatcctcatgctgccggaggaggtcgaggaggtcatcggcaacaagcccgagtccgacatcctcgtccacacggcctacgacgagtccaccgacgagaacgtgatgctcctgacctcggacgctcccgagtacaagccatgggccctggtcatccaggacagcaacggcgagaacaagatcaagatgctctccggcggcagcccgaagaagaagcgcaaagtgtga

SEQ ID NO: 17 - protein, 1714 aa, Artificial Sequence
  Synthetic
MPKKKRKVMSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQLTFFTIALQSCHYQRLPPHILWATGLKGGGGSGGGGSGGGGSGGGGSGGGGSGGGGSMSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIARGERNLLYIVVVDGKGNIVEQYSLNEIINNFNGIRIKTDYHSLLDKKEKERFEARQNWTSIENIKELKAGYISQVVHKICELVEKYDAVIALADLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVAFLISPVKNSDGIFYDSRNYEAQENAILPKNADANGAYNIARKVLWAIGQFKKAEDEKLDKVKIAISNKEWLEYAQTSVKHGSPKKKRKVGGSTGGGSGGGSGGGSSGTNLSDIIEKETGKQLVIQESILMLPEEVEEVIGNKPESDILVHTAYDESTDENVMLLTSDAPEYKPWALVIQDSNGENKIKMLGGGGSGGGGSGGGGSTNLSDIIEKETGKQLVIQESILMLPEEVEEVIGNKPESDILVHTAYDESTDENVMLLTSDAPEYKPWALVIQDSNGENKIKMLSGGSPKKKRKV

SEQ ID NO: 18 - DNA, 4767 bp, Artificial Sequence
  Synthetic
atgccgaagaagaagcgcaaggtcatgtccagcgagaccggccccgtggcggtggaccccaccctgcgcaggcgcatcgagccgcacgagttcgaggtgttcttcgaccccagggagctccgcaaggagacctgcctcctgtacgagatcaactggggcggcaggcactccatctggaggcacacgagccagaacaccaacaagcacgtcgaggtgaacttcatcgagaagttcaccacggagaggtacttctgcccgaacacgcgctgctccatcacgtggttcctctcgtggagcccatgcggcgagtgctccagggcgatcacggagttcctcagccgctacccgcacgtgaccctgttcatctacatcgctaggctctaccaccacgcggaccccaggaacaggcagggcctcagggacctgatctccagcggcgtcacgatccagatcatgaccgagcaggagtccggctactgctggaggaacttcgtgaactactccccgagcaacgaggcccactggccccgctacccgcacctctgggtccgcctctacgtgctcgagctgtactgcatcatcctcggcctgccgccctgcctcaacatcctgaggcgcaagcagccccagctgacgttcttcaccatcgccctgcagagctgccactaccagaggctcccgccccacatcctgtgggcgaccgggctcaagtcgggcagcgagacccccggcacctccgagtcggctaccccagagtccatgagcaagctggagaagttcacgaactgctactccctcagcaagaccctgaggttcaaggcgatcccggtcggcaagacccaggagaacatcgacaacaagcggctgctggtggaggacgagaagagggctgaggactacaagggcgtgaagaagctcctggaccgctactacctgtccttcatcaacgacgtgctccacagcatcaagctcaagaacctgaacaactacatcagcctcttcaggaagaagacgcgcaccgagaaggagaacaaggagctcgagaacctggagatcaacctgaggaaggagatcgccaaggcgttcaagggcaacgagggctacaagtccctcttcaagaaggacatcatcgagacgatcctcccggagttcctggacgacaaggacgagatcgccctggtcaactccttcaacggcttcaccacggcgttcaccggcttcttcgacaaccgcgagaacatgttcagcgaggaggccaagtccacgagcatcgcgttcaggtgcatcaacgagaacctcacccgctacatctccaacatggacatcttcgagaaggtcgacgcgatcttcgacaagcacgaggtgcaggagatcaaggagaagatcctgaacagcgactacgacgtcgaggacttcttcgagggcgagttcttcaacttcgtcctcacgcaggagggcatcgacgtgtacaacgccatcatcggtggcttcgtgaccgagtccggcgagaagatcaagggcctgaacgagtacatcaacctctacaaccagaagaccaagcagaagctgccgaagttcaagcccctgtacaagcaggtgctctccgacagggagtccctcagcttctacggcgagggctacacgagcgacgaggaggtcctggaggtgttccgcaacaccctcaacaagaacagcgagatcttctccagcatcaagaagctcgagaagctgttcaagaacttcgacgagtactccagcgccggcatcttcgtcaagaacggcccggcgatctccacgatcagcaaggacatcttcggcgagtggaacgtgatccgcgacaagtggaacgccgagtacgacgacatccacctcaagaagaaggcggtggtcaccgagaagtacgaggacgacaggcgcaagtccttcaagaagatcggctccttcagcctcgagcagctgcaggagtacgccgacgcggacctgagcgtggtcgagaagctcaaggagatcatcatccagaaggtcgacgagatctacaaggtgtacggctccagcgagaagctcttcgacgcggacttcgtcctcgagaagtccctgaagaagaacgacgccgtggtcgcgatcatgaaggacctcctggactccgtgaagagcttcgagaattacatcaaggccttcttcggcgagggcaaggagacgaacagggacgagtccttctacggcgacttcgtcctggcctacgacatcctcctgaaggtggaccacatctacgacgcgatccgcaactacgtgacccagaagccgtacagcaaggacaagttcaagctctacttccagaacccccagttcatgggcggctgggacaaggacaaggagacggactacagggcgaccatcctgcgctacggcagcaagtactacctcgccatcatggacaagaagtacgcgaagtgcctgcagaagatcgacaaggacgacgtcaacggcaactacgagaagatcaactacaagctcctgccgggccccaacaagatgctcccgaaggtgttcttctccaagaagtggatggcctactacaaccccagcgaggacatccagaagatctacaagaacggcacgttcaagaagggcgacatgttcaacctgaacgactgccacaagctcatcgacttcttcaaggactccatcagccgctacccgaagtggtccaacgcctacgacttcaacttcagcgagaccgagaagtacaaggacatcgcgggcttctaccgcgaggtcgaggagcagggctacaaggtgtccttcgagtccgccagcaagaaggaggtcgacaagctggtggaggagggcaagctctacatgttccagatctacaacaaggacttctccgacaagagccacggcacgcccaacctgcacaccatgtacttcaagctcctgttcgacgagaacaaccacggccagatcaggctgtccggcggcgccgagctcttcatgaggagggcgagcctgaagaaggaggagctggtggtccaccccgctaacagcccaatcgcgaacaagaacccggacaaccccaagaagaccacgaccctgtcctacgacgtgtacaaggacaagaggttcagcgaggaccagtacgagctccacatcccgatcgcgatcaacaagtgccccaagaacatcttcaagatcaacaccgaggtccgcgtgctcctgaagcacgacgacaacccctacgtgatcggcatcgctaggggcgagaggaacctcctgtacatcgtggtcgtggacggcaagggcaacatcgtggagcagtactccctcaacgagatcatcaacaacttcaacggcatcaggatcaagacggactaccacagcctcctggacaagaaggagaaggagaggttcgaggcccgccagaactggacctccatcgagaacatcaaggagctgaaggcgggctacatcagccaggtcgtgcacaagatctgcgagctcgtcgagaagtacgacgccgtgatcgccctcgcggacctgaactccggcttcaagaacagccgcgtcaaggtggagaagcaggtctaccagaagttcgagaagatgctcatcgacaagctgaactacatggtggacaagaagtccaacccctgcgctacgggcggcgcgctgaagggctaccagatcaccaacaagttcgagagcttcaagtccatgagcactcagaacggcttcatcttctacatcccggcgtggctcacgtccaagatcgaccccagcaccggcttcgtcaacctcctgaagacgaagtacacctccatcgccgacagcaagaagttcatctccagcttcgaccgcatcatgtatgtgccggaggaggacctgttcgagttcgccctcgactacaagaacttctcccgcacggacgcggactacatcaagaagtggaagctgtacagctacggcaaccgcatccgcatcttcaggaaccccaagaagaacaacgtcttcgactgggaggaggtgtgcctgacctccgcgtacaaggagctcttcaacaagtacggcatcaactaccagcagggcgacatcagggctctcctgtgcgagcagagcgacaaggccttctactccagcttcatggcgctgatgtccctcatgctgcagatgaggaactcgatcaccggcaggacggacgtggccttcctcatctccccggtgaagaacagcgacggcatcttctacgactccaggaactacgaggcccaggagaacgcgatcctcccaaagaacgcggacgccaacggcgcctacaacatcgccaggaaggtcctctgggctatcggccagttcaagaaggcggaggacgagaagctggacaaggtgaagatcgccatcagcaacaaggagtggctcgagtacgcccagacctcggtcaagcacggcagcccgaagaagaagcgcaaggtgtccggcggcagcacgaacctgtccgacatcatcgagaaggagaccggcaagcagctcgtgatccaggagagcatcctcatgctgccggaggaggtcgaggaggtcatcggcaacaagcccgagtccgacatcctcgtccacacggcctacgacgagtccaccgacgagaacgtgatgctcctgacctcggacgctcccgagtacaagccatgggccctggtcatccaggacagcaacggcgagaacaagatcaagatgctctccggcggcagcccgaagaagaagcgcaaagtgtga

SEQ ID NO: 19 - protein, 1588 aa, Artificial Sequence
  Synthetic
MPKKKRKVMSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQLTFFTIALQSCHYQRLPPHILWATGLKSGSETPGTSESATPESMSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIARGERNLLYIVVVDGKGNIVEQYSLNEIINNFNGIRIKTDYHSLLDKKEKERFEARQNWTSIENIKELKAGYISQVVHKICELVEKYDAVIALADLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVAFLISPVKNSDGIFYDSRNYEAQENAILPKNADANGAYNIARKVLWAIGQFKKAEDEKLDKVKIAISNKEWLEYAQTSVKHGSPKKKRKVSGGSTNLSDIIEKETGKQLVIQESILMLPEEVEEVIGNKPESDILVHTAYDESTDENVMLLTSDAPEYKPWALVIQDSNGENKIKMLSGGSPKKKRKV

SEQ ID NO: 20 - DNA, 5229 bp, Artificial Sequence
  Synthetic
atgccgaagaagaagcgcaaggtgtccagcgagaccggccccgtggcggtcgaccccaccctgcgcaggcgcatcgagccgcacgagttcgaggtcttcttcgaccccagggagctccgcaaggagacctgcctcctgtacgagatcaactggggcggcaggcactccatctggaggcacaccagccagaacacgaacaagcacgtggaggtcaacttcatcgagaagttcaccacggagaggtacttctgcccgaacacccgctgctccatcacctggttcctctcgtggagcccatgcggcgagtgctccagggcgatcacggagttcctcagccgctacccgcacgtgaccctcttcatctacatcgctaggctgtaccaccacgcggaccccaggaacaggcaggggctcagggacctgatctccagcggcgtgaccatccagatcatgacggagcaggagtccggctactgctggcgcaacttcgtcaactactccccgagcaacgaggcccactggccccgctacccgcacctgtgggtgcgcctctacgtcctcgagctgtactgcatcatcctcggcctgccgccctgcctcaacatcctgaggcgcaagcagccccagctcaccttcttcacgatcgccctgcagagctgccactaccagcggctgccgccccacatcctctgggccaccggcctgaagtcgggcagcgagacgcccggcacgtccgagtcggctaccccagagctcaaggacaagaagtacagcatcggcctggcaatcggcaccaacagcgtgggctgggccgtgatcaccgacgagtacaaggtgccgagcaagaagttcaaggtgctgggcaacaccgacaggcacagcatcaagaagaacctgatcggcgccctgctgttcgacagcggcgagaccgccgaggccaccaggctgaagaggaccgccaggaggaggtacaccaggaggaagaacaggatctgctacctgcaggagatcttcagcaacgagatggccaaggtggacgacagcttcttccacaggctggaggagagcttcctggtggaggaggacaagaagcacgagaggcacccgatcttcggcaacatcgtggacgaggtggcctaccacgagaagtacccgaccatctaccacctgaggaagaagctggtggacagcaccgacaaggccgacctgaggctgatctacctggccctggcccacatgatcaagttcaggggccacttcctgatcgagggcgacctgaacccggacaacagcgacgtggacaagctgttcatccagctggtgcagacctacaaccagctgttcgaggagaacccgatcaacgccagcggcgtggacgccaaggccatcctgagcgccaggctgagcaagagcaggaggctggagaacctgatcgcccagctgccgggcgagaagaagaacggcctgttcggcaacctgatcgccctgagcctgggcctgaccccgaacttcaagagcaacttcgacctggccgaggacgccaagctgcagctgagcaaggacacctacgacgacgacctggacaacctgctggcccagatcggcgaccagtacgccgacctgttcctggccgccaagaacctgagcgacgccatcctgctgagcgacatcctgagggtgaacaccgagatcaccaaggccccgctgagcgccagcatgatcaagaggtacgacgagcaccaccaggacctgaccctgctgaaggccctggtgaggcagcagctgccggagaagtacaaggagatcttcttcgaccagagcaagaacggctacgccggctacatcgacggcggcgccagccaggaggagttctacaagttcatcaagccgatcctggagaagatggacggcaccgaggagctgctggtgaagctgaacagggaggacctgctgaggaagcagaggaccttcgacaacggcagcatcccgcaccagatccacctgggcgagctgcacgccatcctgaggaggcaggaggacttctacccgttcctgaaggacaacagggagaagatcgagaagatcctgaccttccgcatcccgtactacgtgggcccgctggccaggggcaacagcaggttcgcctggatgaccaggaagagcgaggagaccatcaccccgtggaacttcgaggaggtggtggacaagggcgccagcgcccagagcttcatcgagaggatgaccaacttcgacaagaacctgccgaacgagaaggtgctgccgaagcacagcctgctgtacgagtacttcaccgtgtacaacgagctgaccaaggtgaagtacgtgaccgagggcatgaggaagccggccttcctgagcggcgagcagaagaaggccatcgtggacctgctgttcaagaccaacaggaaggtgaccgtgaagcagctgaaggaggactacttcaagaagatcgagtgcttcgacagcgtggagatcagcggcgtggaggacaggttcaacgccagcctgggcacctaccacgacctgctgaagatcatcaaggacaaggacttcctggacaacgaggagaacgaggacatcctggaggacatcgtgctgaccctgaccctgttcgaggacagggagatgatcgaggagaggctgaagacctacgcccacctgttcgacgacaaggtgatgaagcagctgaagaggaggaggtacaccggctggggcaggctgagcaggaagctgatcaacggcatcagggacaagcagagcggcaagaccatcctggacttcctgaagagcgacggcttcgccaacaggaacttcatgcagctgatccacgacgacagcctgaccttcaaggaggacatccagaaggcccaggtgagcggccagggcgacagcctgcacgagcacatcgccaacctggccggcagcccggccatcaagaagggcatcctgcagaccgtgaaggtggtggacgagctggtgaaggtgatgggcaggcacaagccggagaacatcgtgatcgagatggccagggagaaccagaccacccagaagggccagaagaacagcagggagaggatgaagaggatcgaggagggcatcaaggagctgggcagccagatcctgaaggagcacccggtggagaacacccagctgcagaacgagaagctgtacctgtactacctgcagaacggcagggacatgtacgtggaccaggagctggacatcaacaggctgagcgactacgacgtggaccacatcgtgccgcagagcttcctgaaggacgacagcatcgacaacaaggtgctgaccaggagcgacaagaacaggggcaagagcgacaacgtgccgagcgaggaggtggtgaagaagatgaaaaactactggaggcagctgctgaacgccaagctgatcacccagaggaagttcgacaacctgaccaaggccgagaggggcggcctgagcgagctggacaaggccggcttcattaaaaggcagctggtggagaccaggcagatcaccaagcacgtggcccagatcctggacagcaggatgaacaccaagtacgacgagaacgacaagctgatcagggaggtgaaggtgatcaccctgaagagcaagctggtgagcgacttcaggaaggacttccagttctacaaggtgagggagatcaataattaccaccacgcccacgacgcctacctgaacgccgtggtgggcaccgccctgattaaaaagtacccgaagctggagagcgagttcgtgtacggcgactacaaggtgtacgacgtgaggaagatgatcgccaagagcgagcaggagatcggcaaggccaccgccaagtacttcttctacagcaacatcatgaacttcttcaagaccgagatcaccctggccaacggcgagatcaggaagaggccgctgatcgagaccaacggcgagaccggcgagatcgtgtgggacaagggcagggacttcgccaccgtgaggaaggtgctgtccatgccgcaggtgaacatcgtgaagaagaccgaggtgcagaccggcggcttcagcaaggagagcatcctgccgaagaggaacagcgacaagctgatcgccaggaagaaggactgggatccgaagaagtacggcggcttcgacagcccgaccgtggcctacagcgtgctggtggtggccaaggtggagaagggcaagagcaagaagctgaagagcgtgaaggagctggtgggcatcaccatcatggagaggagcagcttcgagaagaacccagtggacttcctggaggccaagggctacaaggaggtgaagaaggacctgatcattaaactgccgaagtacagcctgttcgagctggagaacggcaggaagaggatgctggccagcgccggcgagctgcagaagggcaacgagctggccctgccgagcaagtacgtgaacttcctgtacctggccagccactacgagaagctgaagggcagcccggaggacaacgagcagaagcagctgttcgtggagcagcacaagcactacctggacgagatcatcgagcagatcagcgagttcagcaagagggtgatcctggccgacgccaacctggacaaggtgctgagcgcctacaacaagcacagggacaagccgatcagggagcaggccgagaacatcatccacctgttcaccctgaccaacctgggcgccccggccgccttcaagtacttcgacaccaccatcgacaggaagaggtacaccagcaccaaggaggtgctggacgccaccctgatccaccagagcatcaccggcctgtacgagaccaggatcgacctgagccagctgggcggcgacagcagcccgccgaagaagaagaggaaggtgagctggaaggacgccagcggctggagcaggatgaccagggactccggcggcagcaccaacctctccgacatcatcgagaaggagacgggcaagcagctcgtgatccaggagagcatcctcatgctgccggaggaggtggaggaggtcatcggcaacaagcccgagtccgacatcctcgtgcacacggcctacgacgagtccaccgacgagaacgtcatgctcctgacctcggacgctcccgagtacaagccatgggccctcgtgatccaggacagcaacggcgagaacaagatcaagatgctctccggcggcagcccgaagaagaagcgcaaagtctga

SEQ ID NO: 21 - protein, 1742 aa, Artificial Sequence
  Synthetic
MPKKKRKVSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQLTFFTIALQSCHYQRLPPHILWATGLKSGSETPGTSESATPELKDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELVGITIMERSSFEKNPVDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSSPPKKKRKVSWKDASGWSRMTRDSGGSTNLSDIIEKETGKQLVIQESILMLPEEVEEVIGNKPESDILVHTAYDESTDENVMLLTSDAPEYKPWALVIQDSNGENKIKMLSGGSPKKKRKV

SEQ ID NO: 22 - protein, 1316 aa, Acidaminococcus fermentans
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIARGERNLIYITVIDSTGKILEQRSLNTIQQFDYQKKLDNREKERVAARQAWSVVGTIKDLKQGYLSQVIHEIVDLMIHYQAVVVLANLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEAYINSPVRDLNGVCFDSRFQNPEWPMDADANGAYHIALKGQLLLNHLKESKDLKLQNGISNQDWLAYIQELRNGSPKKKRKV

SEQ ID NO: 23 - DNA, 4809 bp, Artificial Sequence
  Codon Optimized
atgccgaagaagaagcgcaaggtcatgtccagcgagaccggccccgtggcggtggaccccaccctgcgcaggcgcatcgagccgcacgagttcgaggtgttcttcgaccccagggagctccgcaaggagacctgcctcctgtacgagatcaactggggcggcaggcactccatctggaggcacacgagccagaacaccaacaagcacgtcgaggtgaacttcatcgagaagttcaccacggagaggtacttctgcccgaacacgcgctgctccatcacgtggttcctctcgtggagcccatgcggcgagtgctccagggcgatcacggagttcctcagccgctacccgcacgtgaccctgttcatctacatcgctaggctctaccaccacgcggaccccaggaacaggcagggcctcagggacctgatctccagcggcgtcacgatccagatcatgaccgagcaggagtccggctactgctggaggaacttcgtgaactactccccgagcaacgaggcccactggccccgctacccgcacctctgggtccgcctctacgtgctcgagctgtactgcatcatcctcggcctgccgccctgcctcaacatcctgaggcgcaagcagccccagctgacgttcttcaccatcgccctgcagagctgccactaccagaggctcccgccccacatcctgtgggcgaccgggctcaaggggggcgggggctcaggcgggggcgggagcggcggcgggggctctgggggcggcggcagcggcgggggcggcagcgggggcggcgggtcgatgagcaagctggagaagttcacgaactgctactccctcagcaagaccctgaggttcaaggcgatcccggtcggcaagacccaggagaacatcgacaacaagcggctgctggtggaggacgagaagagggctgaggactacaagggcgtgaagaagctcctggaccgctactacctgtccttcatcaacgacgtgctccacagcatcaagctcaagaacctgaacaactacatcagcctcttcaggaagaagacgcgcaccgagaaggagaacaaggagctcgagaacctggagatcaacctgaggaaggagatcgccaaggcgttcaagggcaacgagggctacaagtccctcttcaagaaggacatcatcgagacgatcctcccggagttcctggacgacaaggacgagatcgccctggtcaactccttcaacggcttcaccacggcgttcaccggcttcttcgacaaccgcgagaacatgttcagcgaggaggccaagtccacgagcatcgcgttcaggtgcatcaacgagaacctcacccgctacatctccaacatggacatcttcgagaaggtcgacgcgatcttcgacaagcacgaggtgcaggagatcaaggagaagatcctgaacagcgactacgacgtcgaggacttcttcgagggcgagttcttcaacttcgtcctcacgcaggagggcatcgacgtgtacaacgccatcatcggtggcttcgtgaccgagtccggcgagaagatcaagggcctgaacgagtacatcaacctctacaaccagaagaccaagcagaagctgccgaagttcaagcccctgtacaagcaggtgctctccgacagggagtccctcagcttctacggcgagggctacacgagcgacgaggaggtcctggaggtgttccgcaacaccctcaacaagaacagcgagatcttctccagcatcaagaagctcgagaagctgttcaagaacttcgacgagtactccagcgccggcatcttcgtcaagaacggcccggcgatctccacgatcagcaaggacatcttcggcgagtggaacgtgatccgcgacaagtggaacgccgagtacgacgacatccacctcaagaagaaggcggtggtcaccgagaagtacgaggacgacaggcgcaagtccttcaagaagatcggctccttcagcctcgagcagctgcaggagtacgccgacgcggacctgagcgtggtcgagaagctcaaggagatcatcatccagaaggtcgacgagatctacaaggtgtacggctccagcgagaagctcttcgacgcggacttcgtcctcgagaagtccctgaagaagaacgacgccgtggtcgcgatcatgaaggacctcctggactccgtgaagagcttcgagaattacatcaaggccttcttcggcgagggcaaggagacgaacagggacgagtccttctacggcgacttcgtcctggcctacgacatcctcctgaaggtggaccacatctacgacgcgatccgcaactacgtgacccagaagccgtacagcaaggacaagttcaagctctacttccagaacccccagttcatgggcggctgggacaaggacaaggagacggactacagggcgaccatcctgcgctacggcagcaagtactacctcgccatcatggacaagaagtacgcgaagtgcctgcagaagatcgacaaggacgacgtcaacggcaactacgagaagatcaactacaagctcctgccgggccccaacaagatgctcccgaaggtgttcttctccaagaagtggatggcctactacaaccccagcgaggacatccagaagatctacaagaacggcacgttcaagaagggcgacatgttcaacctgaacgactgccacaagctcatcgacttcttcaaggactccatcagccgctacccgaagtggtccaacgcctacgacttcaacttcagcgagaccgagaagtacaaggacatcgcgggcttctaccgcgaggtcgaggagcagggctacaaggtgtccttcgagtccgccagcaagaaggaggtcgacaagctggtggaggagggcaagctctacatgttccagatctacaacaaggacttctccgacaagagccacggcacgcccaacctgcacaccatgtacttcaagctcctgttcgacgagaacaaccacggccagatcaggctgtccggcggcgccgagctcttcatgaggagggcgagcctgaagaaggaggagctggtggtccaccccgctaacagcccaatcgcgaacaagaacccggacaaccccaagaagaccacgaccctgtcctacgacgtgtacaaggacaagaggttcagcgaggaccagtacgagctccacatcccgatcgcgatcaacaagtgccccaagaacatcttcaagatcaacaccgaggtccgcgtgctcctgaagcacgacgacaacccctacgtgatcggcatcgctaggggcgagaggaacctcctgtacatcgtggtcgtggacggcaagggcaacatcgtggagcagtactccctcaacgagatcatcaacaacttcaacggcatcaggatcaagacggactaccacagcctcctggacaagaaggagaaggagaggttcgaggcccgccagaactggacctccatcgagaacatcaaggagctgaaggcgggctacatcagccaggtcgtgcacaagatctgcgagctcgtcgagaagtacgacgccgtgatcgccctcgcggacctgaactccggcttcaagaacagccgcgtcaaggtggagaagcaggtctaccagaagttcgagaagatgctcatcgacaagctgaactacatggtggacaagaagtccaacccctgcgctacgggcggcgcgctgaagggctaccagatcaccaacaagttcgagagcttcaagtccatgagcactcagaacggcttcatcttctacatcccggcgtggctcacgtccaagatcgaccccagcaccggcttcgtcaacctcctgaagacgaagtacacctccatcgccgacagcaagaagttcatctccagcttcgaccgcatcatgtatgtgccggaggaggacctgttcgagttcgccctcgactacaagaacttctcccgcacggacgcggactacatcaagaagtggaagctgtacagctacggcaaccgcatccgcatcttcaggaaccccaagaagaacaacgtcttcgactgggaggaggtgtgcctgacctccgcgtacaaggagctcttcaacaagtacggcatcaactaccagcagggcgacatcagggctctcctgtgcgagcagagcgacaaggccttctactccagcttcatggcgctgatgtccctcatgctgcagatgaggaactcgatcaccggcaggacggacgtggccttcctcatctccccggtgaagaacagcgacggcatcttctacgactccaggaactacgaggcccaggagaacgcgatcctcccaaagaacgcggacgccaacggcgcctacaacatcgccaggaaggtcctctgggctatcggccagttcaagaaggcggaggacgagaagctggacaaggtgaagatcgccatcagcaacaaggagtggctcgagtacgcccagacctcggtcaagcacggcagcccgaagaagaagcgcaaggtgtccggcggcagcacgaacctgtccgacatcatcgagaaggagaccggcaagcagctcgtgatccaggagagcatcctcatgctgccggaggaggtcgaggaggtcatcggcaacaagcccgagtccgacatcctcgtccacacggcctacgacgagtccaccgacgagaacgtgatgctcctgacctcggacgctcccgagtacaagccatgggccctggtcatccaggacagcaacggcgagaacaagatcaagatgctctccggcggcagcccgaagaagaagcgcaaagtgtga

SEQ ID NO: 24 - protein, 1602 aa, Artificial Sequence
  Fusion Protein
MPKKKRKVMSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQLTFFTIALQSCHYQRLPPHILWATGLKGGGGSGGGGSGGGGSGGGGSGGGGSGGGGSMSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIARGERNLLYIVVVDGKGNIVEQYSLNEIINNFNGIRIKTDYHSLLDKKEKERFEARQNWTSIENIKELKAGYISQVVHKICELVEKYDAVIALADLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVAFLISPVKNSDGIFYDSRNYEAQENAILPKNADANGAYNIARKVLWAIGQFKKAEDEKLDKVKIAISNKEWLEYAQTSVKHGSPKKKRKVSGGSTNLSDIIEKETGKQLVIQESILMLPEEVEEVIGNKPESDILVHTAYDESTDENVMLLTSDAPEYKPWALVIQDSNGENKIKMLSGGSPKKKRKV

SEQ ID NO: 25 - DNA, 1802 bp, Saccharum officinarum
gaattcattatgtggtctaggtaggttctatatataagaaaacttgaaatgttctaaaaaaaaattcaagcccatgcatgattgaagcaaacggtatagcaacggtgttaacctgatctagtgatctcttgcaatccttaacggccacctaccgcaggtagcaaacggcgtccccctcctcgatatctccgcggcgacctctggctttttccgcggaattgcgcggtggggacggattccacgagaccgcgacgcaaccgcctctcgccgctgggccccacaccgctcggtgccgtagcctcacgggactctttctccctcctcccccgttataaattggcttcatcccctccttgcctcatccatccaaatcccagtccccaatcccatcccttcgtaggagaaattcatcgaagctaagcgaatcctcgcgatcctctcaaggtactgcgagttttcgatccccctctcgacccctcgtatgtttgtgtttgtcgtagcgtttgattaggtatgctttccctgtttgtgttcgtcgtagcgtttgattaggtatgctttccctgttcgtgttcatcgtagtgtttgattaggtcgtgtgaggcgatggcctgctcgcgtccttcgatctgtagtcgatttgcgggtcgtggtgtagatctgcgggctgtgatgaagttatttggtgtgatctgctcgcctgattctgcgggttggctcgagtagatatgatggttggaccggttggttcgtttaccgcgctagggttgggctgggatgatgttgcatgcgccgttgcgcgtgatcccgcagcaggacttgcgtttgattgccagatctcgttacgattatgtgatttggtttggactttttagatctgtagcttctgcttatgtgccagatgcgcctactgctcatatgcctgatgataatcataaatggctgtggaactaactagttgattgcggagtcatgtatcagctacaggtgtagggactagctacaggtgtagggacttgcgtctaattgtttggtcctttactcatgttgcaattatgcaatttagtttagattgtttgttccactcatctaggctgtaaaagggacactgcttagattgctgtttaatctttttagtagattatattatattggtaacttattacccctattacatgccatacgtgacttctgctcatgcctgatgataatcatagatcactgtggaattaattagttgattgttgaatcatgtttcatgtacataccacggcacaattgcttagttccttaacaaatgcaaattttactgatccatgtatgatttgcgtggttctctaatgtgaaatactatagctacttgttagtaagaatcaggttcgtatgcttaatgctgtatgtgccttctgctcatgcctgatgataatcatatatcactggaattaattagttgatcgtttaatcatatatcaagtacataccatgccacaatttttagtcacttaacccatgcagattgaactggtccctgcatgttttgctaaattgttctattctgattagaccatatatcatgtatttttttttggtaatggttctcttattttaaatgctatatagttctggtacttgttagaaagatctgcttcatagtttagttgcctatccctcgaattaggatgctgagcagctgatcctatagctttgtttcatgtatcaattcttttgtgttcaacagtcagtttttgttagattcattgtaacttatggtcgcttactcttctggtcctcaatgcttgcag

SEQ ID NO: 26 - DNA, 23 bp, Artificial Sequence
  synthetic
gggaaagaccgaggagaagatct

SEQ ID NO: 27 - DNA, 20 bp, Artificial Sequence
  Synthetic
aagaccgaggagaagatcta

SEQ ID NO: 28 - DNA, 90 bp, Zea mays
gtttggggaaagaccgaggagaagatctacgggcctgtcgctggaacggactacagggacaaccagctgcggttcagcctgctatgccag

SEQ ID NO: 29 - DNA, 24 bp, Artificial Sequence
  Synthetic
agatgggagacgggtacgagacgg

SEQ ID NO: 30 - DNA, 25 bp, Artificial Sequence
  Synthetic
gtatgggttgttgttgaggctcagg

SEQ ID NO: 31 - DNA, 25 bp, Artificial Sequence
  Synthetic
gaccacccactgttcctggagaggg

SEQ ID NO: 32 - DNA, 3783 bp, Artificial Sequence
  Synethic
atggctcctaagaagaagcggaaggttggtattcacggggtgcctgcggcttcaaagctcgagaaattcaccaactgttattcgttgagcaaaacactgcggtttaaagcgattccagtcggcaagactcaagagaatatagacaataagcggctgttggtggaagatgaaaagcgcgcggaagactacaaaggggtgaagaagttgttggacagatactacctctcttttatcaatgatgtcttgcactcaatcaaattgaagaatctgaacaactacatctccctcttcagaaagaaaacaaggacagaaaaggagaataaggaacttgaaaatttggagatcaatctgaggaaagagatcgcgaaagcctttaaaggcaacgaaggatacaaaagtctgttcaagaaggatataattgagacaattttgccagagttcctcgatgacaaggacgagattgcgctggtcaattcgttcaacggattcacaacagcattcacaggcttctttgataatcgggaaaatatgttctctgaggaggcaaagtccacttctattgcgttcaggtgtatcaatgagaatctcactaggtacatttccaacatggatatctttgagaaggttgacgcaatttttgacaagcacgaagttcaggagattaaggagaagatcctcaattccgattatgacgttgaggacttcttcgagggtgagttttttaatttcgtgctcactcaagagggtatcgacgtgtataatgcgatcatcggtgggttcgtgactgagtccggtgaaaagattaagggattgaacgagtatatcaacctttacaaccaaaagacgaaacagaagctgccaaagttcaagcctctttacaaacaggttctttcagaccgcgagtcactctcgttctatggggagggctacacttcggatgaggaagtcctggaggtgttcaggaatactctcaataagaattcggagattttctcttctataaaaaaactggaaaagttgtttaagaattttgacgaatactctagcgccggcatatttgtgaaaaacggcccggccatatcaacgataagtaaagatatcttcggcgaatggaacgtgatcagagacaaatggaacgcggagtatgacgatattcacctgaagaagaaggctgtcgtaacggagaagtacgaggatgatcgcaggaaaagcttcaaaaagatcggaagtttcagcctggaacagttgcaggagtatgctgacgccgatcttagcgtcgtcgagaagttgaaggagataatcatccaaaaggtcgacgagatatataaagtctatggatcaagtgaaaaactgttcgacgccgacttcgttttggagaagtccctgaagaagaacgacgctgttgttgccattatgaaggatctgctcgacagcgtgaagagtttcgagaactatattaaggcttttttcggggaggggaaggagactaacagagatgagtccttctacggagacttcgtcctcgcgtacgatatactccttaaggtagaccacatctacgacgcaatcagaaattacgtgacacaaaagccgtacagcaaggacaagttcaaactctacttccagaacccccagttcatgggcggctgggacaaggacaaggaaacggattacagggctacgatcctgaggtatggttcaaaatactacttggcgattatggacaagaagtacgccaagtgtctccagaagattgacaaagacgatgtcaatggcaattatgagaagatcaactacaagctgcttccgggtccgaacaagatgctcccaaaggttttcttcagcaagaaatggatggcctactataacccaagcgaggacatccagaagatttataagaacggtacgttcaagaagggcgacatgttcaatcttaacgactgtcacaagctgatcgacttcttcaaagactcaattagccggtacccaaagtggtctaacgcctatgacttcaacttttcggaaaccgagaagtacaaggatatagccggattttatagagaggtggaagagcagggctacaaggtgtcattcgagtccgccagcaagaaggaagtggacaagctcgtggaagagggtaagctctacatgttccagatttataataaagactttagcgataagagccacgggacacctaatctccacacaatgtatttcaagctgctcttcgacgagaataaccacggccaaatcaggttgtcaggaggggctgaactcttcatgcggcgcgctagccttaagaaggaggagcttgtagtccaccctgcgaatagtccaattgcgaataagaacccggacaatcctaaaaagactacaacattgagctacgacgtgtacaaggataagaggttttccgaggatcagtacgagctccacatcccgattgcgatcaacaagtgcccaaagaatattttcaagataaacacagaggtgcgtgtactcctgaagcatgacgacaatccttacgtcattgggattgatcggggcgagaggaacctcctctatattgtggtggtggacgggaaggggaacatagtcgaacagtactcccttaacgaaataattaacaatttcaacggcatccgtatcaagaccgactaccattcgttgctggacaagaaggagaaggagagatttgaggcgcggcaaaattggacaagtatcgagaacatcaaggaactcaaagcaggttatatctctcaagttgtgcataagatatgcgagctggttgagaagtatgacgcagtgatcgctcttgaggacctcaactcgggctttaagaattctagagttaaagtggagaagcaggtctatcaaaagttcgagaagatgcttatagataagctcaactacatggtcgataagaaatcgaacccatgtgccaccggcggcgcactcaaaggttaccaaataacaaacaaattcgagtccttcaaatcgatgagtactcagaatgggttcatattttatataccggcgtggcttacgtctaagatcgacccgtcaactggttttgtcaacctgttgaagacgaaatacacgtccattgccgattcaaaaaagttcatatctagttttgatcgtattatgtacgtcccagaggaagatcttttcgagtttgctctcgactacaaaaacttttcgcgcaccgatgcggattacattaaaaaatggaaactctattcgtacggcaacagaatcaggatttttcgcaaccctaagaagaataacgtctttgattgggaggaagtttgcttgactagcgcgtacaaggagctctttaataagtatggcattaactaccaacagggtgatatcagagcactgctttgcgaacaatctgacaaggctttctactcatccttcatggctttgatgagcctgatgctccagatgagaaattcaattacaggcagaaccgacgtggatttcttgatctccccggttaaaaattctgatggcatcttttacgatagcaggaactatgaagcgcaagagaatgcgattctgccaaaaaatgcagacgccaacggtgcctataacatcgccaggaaagtcctgtgggcgatcggccagttcaaaaaggccgaagacgaaaaattggacaaggtcaaaatcgctatcagcaacaaagagtggctggagtatgctcagacatccgtaaagcataagcgtcctgctgccaccaaaaaggccggacaggctaagaaaaagaagtga

SEQ ID NO: 33 - protein, 1260 aa, Artificial Sequence
  Fusion protein
MAPKKKRKVGIHGVPAASKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHKRPAATKKAGQAKKKK

SEQ ID NO: 34 - DNA, 3873 bp, Artificial Sequence
  Synthetic
atgccgaagaagaagcgcaaggtcgggggcgggggctcaggcgggggcgggagcggcggcgggggctctgggggcggcggcagcggcgggggcggcagcgggggcggcgggtcgatgagcaagctggagaagttcacgaactgctactccctcagcaagaccctgaggttcaaggcgatcccggtcggcaagacccaggagaacatcgacaacaagcggctgctggtggaggacgagaagagggctgaggactacaagggcgtgaagaagctcctggaccgctactacctgtccttcatcaacgacgtgctccacagcatcaagctcaagaacctgaacaactacatcagcctcttcaggaagaagacgcgcaccgagaaggagaacaaggagctcgagaacctggagatcaacctgaggaaggagatcgccaaggcgttcaagggcaacgagggctacaagtccctcttcaagaaggacatcatcgagacgatcctcccggagttcctggacgacaaggacgagatcgccctggtcaactccttcaacggcttcaccacggcgttcaccggcttcttcgacaaccgcgagaacatgttcagcgaggaggccaagtccacgagcatcgcgttcaggtgcatcaacgagaacctcacccgctacatctccaacatggacatcttcgagaaggtcgacgcgatcttcgacaagcacgaggtgcaggagatcaaggagaagatcctgaacagcgactacgacgtcgaggacttcttcgagggcgagttcttcaacttcgtcctcacgcaggagggcatcgacgtgtacaacgccatcatcggtggcttcgtgaccgagtccggcgagaagatcaagggcctgaacgagtacatcaacctctacaaccagaagaccaagcagaagctgccgaagttcaagcccctgtacaagcaggtgctctccgacagggagtccctcagcttctacggcgagggctacacgagcgacgaggaggtcctggaggtgttccgcaacaccctcaacaagaacagcgagatcttctccagcatcaagaagctcgagaagctgttcaagaacttcgacgagtactccagcgccggcatcttcgtcaagaacggcccggcgatctccacgatcagcaaggacatcttcggcgagtggaacgtgatccgcgacaagtggaacgccgagtacgacgacatccacctcaagaagaaggcggtggtcaccgagaagtacgaggacgacaggcgcaagtccttcaagaagatcggctccttcagcctcgagcagctgcaggagtacgccgacgcggacctgagcgtggtcgagaagctcaaggagatcatcatccagaaggtcgacgagatctacaaggtgtacggctccagcgagaagctcttcgacgcggacttcgtcctcgagaagtccctgaagaagaacgacgccgtggtcgcgatcatgaaggacctcctggactccgtgaagagcttcgagaattacatcaaggccttcttcggcgagggcaaggagacgaacagggacgagtccttctacggcgacttcgtcctggcctacgacatcctcctgaaggtggaccacatctacgacgcgatccgcaactacgtgacccagaagccgtacagcaaggacaagttcaagctctacttccagaacccccagttcatgggcggctgggacaaggacaaggagacggactacagggcgaccatcctgcgctacggcagcaagtactacctcgccatcatggacaagaagtacgcgaagtgcctgcagaagatcgacaaggacgacgtcaacggcaactacgagaagatcaactacaagctcctgccgggccccaacaagatgctcccgaaggtgttcttctccaagaagtggatggcctactacaaccccagcgaggacatccagaagatctacaagaacggcacgttcaagaagggcgacatgttcaacctgaacgactgccacaagctcatcgacttcttcaaggactccatcagccgctacccgaagtggtccaacgcctacgacttcaacttcagcgagaccgagaagtacaaggacatcgcgggcttctaccgcgaggtcgaggagcagggctacaaggtgtccttcgagtccgccagcaagaaggaggtcgacaagctggtggaggagggcaagctctacatgttccagatctacaacaaggacttctccgacaagagccacggcacgcccaacctgcacaccatgtacttcaagctcctgttcgacgagaacaaccacggccagatcaggctgtccggcggcgccgagctcttcatgaggagggcgagcctgaagaaggaggagctggtggtccaccccgctaacagcccaatcgcgaacaagaacccggacaaccccaagaagaccacgaccctgtcctacgacgtgtacaaggacaagaggttcagcgaggaccagtacgagctccacatcccgatcgcgatcaacaagtgccccaagaacatcttcaagatcaacaccgaggtccgcgtgctcctgaagcacgacgacaacccctacgtgatcggcatcgacaggggcgagaggaacctcctgtacatcgtggtcgtggacggcaagggcaacatcgtggagcagtactccctcaacgagatcatcaacaacttcaacggcatcaggatcaagacggactaccacagcctcctggacaagaaggagaaggagaggttcgaggcccgccagaactggacctccatcgagaacatcaaggagctgaaggcgggctacatcagccaggtcgtgcacaagatctgcgagctcgtcgagaagtacgacgccgtgatcgccctcgaggacctgaactccggcttcaagaacagccgcgtcaaggtggagaagcaggtctaccagaagttcgagaagatgctcatcgacaagctgaactacatggtggacaagaagtccaacccctgcgctacgggcggcgcgctgaagggctaccagatcaccaacaagttcgagagcttcaagtccatgagcactcagaacggcttcatcttctacatcccggcgtggctcacgtccaagatcgaccccagcaccggcttcgtcaacctcctgaagacgaagtacacctccatcgccgacagcaagaagttcatctccagcttcgaccgcatcatgtatgtgccggaggaggacctgttcgagttcgccctcgactacaagaacttctcccgcacggacgcggactacatcaagaagtggaagctgtacagctacggcaaccgcatccgcatcttcaggaaccccaagaagaacaacgtcttcgactgggaggaggtgtgcctgacctccgcgtacaaggagctcttcaacaagtacggcatcaactaccagcagggcgacatcagggctctcctgtgcgagcagagcgacaaggccttctactccagcttcatggcgctgatgtccctcatgctgcagatgaggaactcgatcaccggcaggacggacgtggacttcctcatctccccggtgaagaacagcgacggcatcttctacgactccaggaactacgaggcccaggagaacgcgatcctcccaaagaacgcggacgccaacggcgcctacaacatcgccaggaaggtcctctgggctatcggccagttcaagaaggcggaggacgagaagctggacaaggtgaagatcgccatcagcaacaaggagtggctcgagtacgcccagacctcggtcaagcacggcagcccgaagaagaagcgcaaggtgtccggcggcagctccggcggcagcccgaagaagaagcgcaaagtgtga

SEQ ID NO: 35 - protein, 1290 aa, Artificial Sequence
  Fusion protein
MPKKKRKVGGGGSGGGGSGGGGSGGGGSGGGGSGGGGSMSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHGSPKKKRKVSGGSSGGSPKKKRKV

SEQ ID NO: 36 - DNA, 3783 bp, Artificial Sequence; identical to SEQ ID NO: 32
  Synthetic

SEQ ID NO: 37 - protein, 1260 aa, Artificial Sequence; identical to SEQ ID NO: 33
  Fusion protein

SEQ ID NO: 38 - DNA, 3873 bp, Artificial Sequence
  Synthetic
atgccgaagaagaagcgcaaggtcgggggcgggggctcaggcgggggcgggagcggcggcgggggctctgggggcggcggcagcggcgggggcggcagcgggggcggcgggtcgatgtcaaagctcgagaaattcaccaactgttattcgttgagcaaaacactgcggtttaaagcgattccagtcggcaagactcaagagaatatagacaataagcggctgttggtggaagatgaaaagcgcgcggaagactacaaaggggtgaagaagttgttggacagatactacctctcttttatcaatgatgtcttgcactcaatcaaattgaagaatctgaacaactacatctccctcttcagaaagaaaacaaggacagaaaaggagaataaggaacttgaaaatttggagatcaatctgaggaaagagatcgcgaaagcctttaaaggcaacgaaggatacaaaagtctgttcaagaaggatataattgagacaattttgccagagttcctcgatgacaaggacgagattgcgctggtcaattcgttcaacggattcacaacagcattcacaggcttctttgataatcgggaaaatatgttctctgaggaggcaaagtccacttctattgcgttcaggtgtatcaatgagaatctcactaggtacatttccaacatggatatctttgagaaggttgacgcaatttttgacaagcacgaagttcaggagattaaggagaagatcctcaattccgattatgacgttgaggacttcttcgagggtgagttttttaatttcgtgctcactcaagagggtatcgacgtgtataatgcgatcatcggtgggttcgtgactgagtccggtgaaaagattaagggattgaacgagtatatcaacctttacaaccaaaagacgaaacagaagctgccaaagttcaagcctctttacaaacaggttctttcagaccgcgagtcactctcgttctatggggagggctacacttcggatgaggaagtcctggaggtgttcaggaatactctcaataagaattcggagattttctcttctataaaaaaactggaaaagttgtttaagaattttgacgaatactctagcgccggcatatttgtgaaaaacggcccggccatatcaacgataagtaaagatatcttcggcgaatggaacgtgatcagagacaaatggaacgcggagtatgacgatattcacctgaagaagaaggctgtcgtaacggagaagtacgaggatgatcgcaggaaaagcttcaaaaagatcggaagtttcagcctggaacagttgcaggagtatgctgacgccgatcttagcgtcgtcgagaagttgaaggagataatcatccaaaaggtcgacgagatatataaagtctatggatcaagtgaaaaactgttcgacgccgacttcgttttggagaagtccctgaagaagaacgacgctgttgttgccattatgaaggatctgctcgacagcgtgaagagtttcgagaactatattaaggcttttttcggggaggggaaggagactaacagagatgagtccttctacggagacttcgtcctcgcgtacgatatactccttaaggtagaccacatctacgacgcaatcagaaattacgtgacacaaaagccgtacagcaaggacaagttcaaactctacttccagaacccccagttcatgggcggctgggacaaggacaaggaaacggattacagggctacgatcctgaggtatggttcaaaatactacttggcgattatggacaagaagtacgccaagtgtctccagaagattgacaaagacgatgtcaatggcaattatgagaagatcaactacaagctgcttccgggtccgaacaagatgctcccaaaggttttcttcagcaagaaatggatggcctactataacccaagcgaggacatccagaagatttataagaacggtacgttcaagaagggcgacatgttcaatcttaacgactgtcacaagctgatcgacttcttcaaagactcaattagccggtacccaaagtggtctaacgcctatgacttcaacttttcggaaaccgagaagtacaaggatatagccggattttatagagaggtggaagagcagggctacaaggtgtcattcgagtccgccagcaagaaggaagtggacaagctcgtggaagagggtaagctctacatgttccagatttataataaagactttagcgataagagccacgggacacctaatctccacacaatgtatttcaagctgctcttcgacgagaataaccacggccaaatcaggttgtcaggaggggctgaactcttcatgcggcgcgctagccttaagaaggaggagcttgtagtccaccctgcgaatagtccaattgcgaataagaacccggacaatcctaaaaagactacaacattgagctacgacgtgtacaaggataagaggttttccgaggatcagtacgagctccacatcccgattgcgatcaacaagtgcccaaagaatattttcaagataaacacagaggtgcgtgtactcctgaagcatgacgacaatccttacgtcattgggattgatcggggcgagaggaacctcctctatattgtggtggtggacgggaaggggaacatagtcgaacagtactcccttaacgaaataattaacaatttcaacggcatccgtatcaagaccgactaccattcgttgctggacaagaaggagaaggagagatttgaggcgcggcaaaattggacaagtatcgagaacatcaaggaactcaaagcaggttatatctctcaagttgtgcataagatatgcgagctggttgagaagtatgacgcagtgatcgctcttgaggacctcaactcgggctttaagaattctagagttaaagtggagaagcaggtctatcaaaagttcgagaagatgcttatagataagctcaactacatggtcgataagaaatcgaacccatgtgccaccggcggcgcactcaaaggttaccaaataacaaacaaattcgagtccttcaaatcgatgagtactcagaatgggttcatattttatataccggcgtggcttacgtctaagatcgacccgtcaactggttttgtcaacctgttgaagacgaaatacacgtccattgccgattcaaaaaagttcatatctagttttgatcgtattatgtacgtcccagaggaagatcttttcgagtttgctctcgactacaaaaacttttcgcgcaccgatgcggattacattaaaaaatggaaactctattcgtacggcaacagaatcaggatttttcgcaaccctaagaagaataacgtctttgattgggaggaagtttgcttgactagcgcgtacaaggagctctttaataagtatggcattaactaccaacagggtgatatcagagcactgctttgcgaacaatctgacaaggctttctactcatccttcatggctttgatgagcctgatgctccagatgagaaattcaattacaggcagaaccgacgtggatttcttgatctccccggttaaaaattctgatggcatcttttacgatagcaggaactatgaagcgcaagagaatgcgattctgccaaaaaatgcagacgccaacggtgcctataacatcgccaggaaagtcctgtgggcgatcggccagttcaaaaaggccgaagacgaaaaattggacaaggtcaaaatcgctatcagcaacaaagagtggctggagtatgctcagacatccgtaaagcatggcagcccgaagaagaagcgcaaggtgtccggcggcagctccggcggcagcccgaagaagaagcgcaaagtgtga

SEQ ID NO: 39 - protein, 1290 aa, Artificial Sequence; identical to SEQ ID NO: 35
  Fusion protein

SEQ ID NO: 40 - DNA, 3852 bp, Artificial Sequence
  Synthetic
atggctcctaagaagaagcggaaggttggtattcacggggtgcctgcggctctgtttcaagattttacacatctgtacccgctgagtaaaacagtgcggttcgagctgaaacccataggaaggaccctcgagcacatccacgcgaagaattttctgagccaggatgaaactatggctgatatgtatcaaaaagttaaggtcattttggacgactatcatcgcgattttattgccgacatgatgggagaggtgaaactcacgaagcttgctgaattttacgacgtctatctgaagttcaggaaaaatcctaaggacgatgggctgcaaaaacagcttaaagaccttcaagctgtccttcggaaggaatcggtgaagcctatagggtcaggtgggaagtacaaaacaggctacgatagactctttggggcaaaactcttcaaagatggaaaagagttgggtgacctcgcaaaattcgttatagcccaagaaggtgagtcttctccgaagctggctcatcttgctcattttgagaagttcagcacgtattttactggatttcacgataatcggaagaatatgtactcggatgaagacaagcatactgcaatagcgtacaggctcatccatgagaatttgccgagattcatcgacaatctgcaaatcttgacaacaatcaaacaaaagcatagcgccctctatgatcagataatcaacgagctcacggcctccgggctcgacgtctccttggcttctcatcttgacgggtatcacaagctccttacacaagaggggatcacggcatacaacaggatcataggagaggtgaatggatatacaaataagcataaccagatatgccacaagagcgagcgcatagcgaaacttagacccttgcacaagcaaatcctttctgacggaatgggagtgtcattccttccgtctaagttcgcggatgatagtgagatgtgccaagcggtcaacgaattttatcgccattatactgacgtgttcgcaaaggtgcaaagtctctttgacggatttgatgatcaccagaaagacgggatctatgttgaacacaaaaaccttaatgaactgagcaaacaggcgttcggcgactttgctttgctggggagggtccttgatggatactacgtggacgttgtcaatccggagttcaatgagcggttcgcaaaggccaagactgacaatgcgaaagccaagcttacaaaagaaaaggacaaattcattaaaggagtccactcactggcttccctcgaacaagcaatagaacaccatacagctagacacgacgatgagagtgttcaagccggaaaacttggccagtacttcaaacacggtttggcgggggttgacaacccgattcagaaaattcacaataaccattcgacgattaaagggtttctggaaagggaaaggcctgctggggaacgggcgctcccgaagatcaagtcaggaaaaaacccagaaatgacacagctcaggcagctgaaggaacttttggacaacgcattgaatgtggcgcacttcgctaagctgctgacaactaaaacaaccttggacaaccaggatggaaatttttacggggagtttggggtgctttacgacgagctggctaaaattccaactctctacaataaggttagagattatctctctcaaaagcccttttctaccgaaaagtataagctcaacttcggcaatccgacccttctcaatgggtgggacctgaacaaagagaaagataactttggggttatacttcagaaggatggatgctattacttggcgcttcttgataaggctcataaaaaagttttcgacaacgcccctaacactggtaagaacgtctaccaaaagatggtctacaaactgttgcccggccccaacaaaatgcttcctaaagtgtttttcgcaaaatcgaatctcgactattataatccatctgccgagctccttgacaaatatgctaaggggacccataaaaagggtgataatttcaacctgaaggactgccacgcgcttatcgactttttcaaagccgggataaataagcatccggagtggcaacattttggttttaaattttcgccaacgtcgtcctatcgcgacctttccgatttctatagggaagttgaacctcaggggtaccaggtcaaatttgttgacattaatgcggactacattgatgaattggtggagcaagggaagctctacctctttcaaatatataacaaagatttctcgccaaaagcgcatggtaaaccgaatcttcataccttgtactttaaagcacttttttcagaagataacttggcggacccgatctacaagctgaatggggaagctcagatcttctacaggaaagcttcgttggacatgaacgagactaccatacatcgcgcgggagaggtgcttgagaacaaaaatcccgacaacccgaaaaagcggcaattcgtttacgacatcatcaaagacaaacggtacacgcaggacaaatttatgctccacgtccccattaccatgaattttggagtccaaggcatgaccattaaggaattcaacaaaaaggtcaaccaaagtattcagcaatacgatgaagtcaatgtcataggcatagatcggggagaaaggcatctgttgtatcttaccgtgattaactctaagggtgaaatactggagcaacggtcacttaacgatataaccacggcgtccgcgaacggtacacaagtgaccactccctaccacaaaatattggataaaagggagatagaacgcttgaatgcccgcgttggctggggtgagattgagaccatcaaagagcttaaatcgggatatttgtctcacgtcgttcatcaaattaaccaactcatgcttaagtacaatgcaatcgttgtgctcgaggacctgaactttggtttcaaaagagggaggttcaaggtggaaaaacaaatttaccagaactttgaaaacgcgcttatcaagaaattgaatcaccttgttttgaaagataaggcagatgacgaaatcgggtcgtataaaaatgcactccagttgacaaataatttcacggatttgaagtcgatcggcaagcaaacagggttcctcttttatgtgccagcgtggaatacatcaaaaattgatccggagacgggatttgtcgacttgctgaagcctaggtatgagaacattgcccaatctcaggcctttttcggcaaattcgataaaatatgctacaacacagacaaaggttattttgaatttcacattgattacgccaaatttacagataaggcgaaaaacagcagacagaaatgggctatctgttctcatggggacaaacgctatgtctacgataagacggctaatcaaaataaaggcgccgcaaaaggtattaatgtgaatgatgagctgaaaagcttgtttgcccgctaccatatcaatgataaacaaccaaacttggtgatggacatatgccagaacaatgacaaagaattccacaagtcactcatgtgcctgcttaaaacccttttggcgctgcggtatagcaatgcatctagcgatgaagactttattttgagtcccgtggccaacgacgagggcgtgttttttaattcagccttggcggacgatacgcagccccagaatgcggacgcaaacggcgcgtaccacattgcactgaagggactgtggcttctgaacgagctgaaaaatagcgacgacctgaataaagtcaagttggccattgacaatcaaacctggttgaatttcgctcaaaatagaaagcgtcctgctgccaccaaaaaggccggacaggctaagaaaaagaagtga

SEQ ID NO: 41 - protein, 1283 aa, Artificial Sequence
  Fusion protein
MAPKKKRKVGIHGVPAALFQDFTHLYPLSKTVRFELKPIGRTLEHIHAKNFLSQDETMADMYQKVKVILDDYHRDFIADMMGEVKLTKLAEFYDVYLKFRKNPKDDGLQKQLKDLQAVLRKESVKPIGSGGKYKTGYDRLFGAKLFKDGKELGDLAKFVIAQEGESSPKLAHLAHFEKFSTYFTGFHDNRKNMYSDEDKHTAIAYRLIHENLPRFIDNLQILTTIKQKHSALYDQIINELTASGLDVSLASHLDGYHKLLTQEGITAYNRIIGEVNGYTNKHNQICHKSERIAKLRPLHKQILSDGMGVSFLPSKFADDSEMCQAVNEFYRHYTDVFAKVQSLFDGFDDHQKDGIYVEHKNLNELSKQAFGDFALLGRVLDGYYVDVVNPEFNERFAKAKTDNAKAKLTKEKDKFIKGVHSLASLEQAIEHHTARHDDESVQAGKLGQYFKHGLAGVDNPIQKIHNNHSTIKGFLERERPAGERALPKIKSGKNPEMTQLRQLKELLDNALNVAHFAKLLTTKTTLDNQDGNFYGEFGVLYDELAKIPTLYNKVRDYLSQKPFSTEKYKLNFGNPTLLNGWDLNKEKDNFGVILQKDGCYYLALLDKAHKKVFDNAPNTGKNVYQKMVYKLLPGPNKMLPKVFFAKSNLDYYNPSAELLDKYAKGTHKKGDNFNLKDCHALIDFFKAGINKHPEWQHFGFKFSPTSSYRDLSDFYREVEPQGYQVKFVDINADYIDELVEQGKLYLFQIYNKDFSPKAHGKPNLHTLYFKALFSEDNLADPIYKLNGEAQIFYRKASLDMNETTIHRAGEVLENKNPDNPKKRQFVYDIIKDKRYTQDKFMLHVPITMNFGVQGMTIKEFNKKVNQSIQQYDEVNVIGIDRGERHLLYLTVINSKGEILEQRSLNDITTASANGTQVTTPYHKILDKREIERLNARVGWGEIETIKELKSGYLSHVVHQINQLMLKYNAIVVLEDLNFGFKRGRFKVEKQIYQNFENALIKKLNHLVLKDKADDEIGSYKNALQLTNNFTDLKSIGKQTGFLFYVPAWNTSKIDPETGFVDLLKPRYENIAQSQAFFGKFDKICYNTDKGYFEFHIDYAKFTDKAKNSRQKWAICSHGDKRYVYDKTANQNKGAAKGINVNDELKSLFARYHINDKQPNLVMDICQNNDKEFHKSLMCLLKTLLALRYSNASSDEDFILSPVANDEGVFFNSALADDTQPQNADANGAYHIALKGLWLLNELKNSDDLNKVKLAIDNQTWLNFAQNRKRPAATKKAGQAKKKK

SEQ ID NO: 42 - DNA, 3936 bp, Artificial Sequence
  Synthetic
atgccgaagaagaagcgcaaggtcgggggcgggggctcaggcgggggcgggagcggcggcgggggctctgggggcggcggcagcggcgggggcggcagcgggggcggcgggtcgatgctgttccaggatttcactcatctgtaccctctctcaaagactgttcggttcgagctcaagcctattgggcggactctggagcacatccacgcgaagaacttcctcagccaggacgaaaccatggccgacatgtaccagaaggtcaaggtcatcctcgacgactaccacagggacttcatcgcggacatgatgggcgaggtgaagctgacgaagctcgccgagttctacgacgtctacctcaagttccgcaagaacccgaaggacgacggcctccagaagcagctcaaggacctgcaggccgtcctgaggaaggagtccgtcaagcccatcggcagcggcggcaagtacaagaccggctacgacaggctgttcggcgccaagctgttcaaggacggcaaggagctcggcgacctggcgaagttcgtgatcgcgcaggagggcgagagctcccccaagctggcccacctggcccacttcgagaagttcagcacgtacttcaccggcttccacgacaacaggaagaacatgtacagcgacgaggacaagcacacggccatcgcctaccgcctcatccacgagaacctgccccgcttcatcgacaacctgcagatcctgacgaccatcaagcagaagcactccgccctgtacgaccagatcatcaacgagctcaccgcgagcggcctcgacgtgtccctcgccagccacctcgacggctaccacaagctcctgacccaggagggcatcaccgcctacaaccgcatcatcggcgaggtgaacggctacaccaacaagcacaaccagatctgccacaagtccgagaggatcgccaagctcaggcccctgcacaagcagatcctcagcgacggcatgggcgtgagcttcctcccgtccaagttcgccgacgactccgagatgtgccaggccgtgaacgagttctacaggcactacaccgacgtgttcgccaaggtgcagtccctgttcgacggcttcgacgaccaccagaaggacggcatctacgtggagcacaagaacctgaacgagctgtccaagcaggccttcggcgacttcgccctcctgggccgcgtgctggacggctactacgtggacgtcgtgaacccggagttcaacgagcgcttcgcgaaggcgaagacggacaacgcgaaggccaagctcaccaaggagaaggacaagttcatcaagggcgtccacagcctcgcgtccctggagcaggcgatcgagcaccacaccgcgcgccacgacgacgagtccgtgcaggccggcaagctcggccagtacttcaagcacggcctggccggcgtcgacaacccgatccagaagatccacaacaaccactccaccatcaagggcttcctggagagggagcgcccggcgggcgagcgcgcgctccccaagatcaagtccggcaagaaccccgagatgacgcagctcaggcagctgaaggagctgctcgacaacgcgctcaacgtggcgcacttcgccaagctgctcacgaccaagaccacgctggacaaccaggacggcaacttctacggcgagttcggcgtcctgtacgacgagctggcgaagatcccgaccctgtacaacaaggtccgcgactacctgagccagaagcccttctccaccgagaagtacaagctcaacttcggcaacccgaccctcctgaacggctgggacctcaacaaggagaaggacaacttcggcgtgatcctccagaaggacggctgctactacctcgccctgctggacaaggcgcacaagaaggtcttcgacaacgccccgaacaccggcaagaacgtgtaccagaagatggtgtacaagctgctccccggccccaacaagatgctgccgaaggtgttcttcgcgaagtccaacctcgactactacaaccccagcgccgagctcctggacaagtacgccaagggcacgcacaagaagggcgacaacttcaacctcaaggactgccacgcgctgatcgacttcttcaaggcgggcatcaacaagcaccccgagtggcagcacttcggcttcaagttcagcccgacctccagctacagggacctcagcgacttctaccgcgaggtggagccccagggctaccaggtgaagttcgtcgacatcaacgccgactacatcgacgagctcgtcgagcagggcaagctctacctgttccagatctacaacaaggacttctccccgaaggcccacggcaagccgaacctccacacgctctacttcaaggccctcttcagcgaggacaacctggccgacccgatctacaagctcaacggcgaggcgcagatcttctaccgcaaggccagcctggacatgaacgaaacgaccatccacagggccggcgaggtcctggagaacaagaacccggacaacccgaagaagaggcagttcgtctacgacatcatcaaggacaagaggtacacccaggacaagttcatgctccacgtcccgatcaccatgaacttcggcgtccagggcatgaccatcaaggagttcaacaagaaggtcaaccagagcatccagcagtacgacgaggtgaacgtcatcggcatcgaccgcggcgagaggcacctgctctacctgacggtcatcaactccaagggcgagatcctcgagcagcgcagcctgaacgacatcacgaccgcgagcgccaacggcacgcaggtcaccacgccgtaccacaagatcctcgacaagcgcgagatcgagaggctgaacgcgcgcgtcggctggggcgagatcgaaacgatcaaggagctcaagtccggctacctcagccacgtcgtgcaccagatcaaccagctcatgctgaagtacaacgcgatcgtggtcctcgaggacctgaacttcggcttcaagaggggccgcttcaaggtggagaagcagatctaccagaacttcgagaacgccctgatcaagaagctcaaccacctggtcctcaaggacaaggcggacgacgagatcggcagctacaagaacgcgctccagctgaccaacaacttcacggacctcaagtccatcggcaagcagacgggcttcctgttctacgtgccggcgtggaacacctccaagatcgacccggaaaccggcttcgtcgacctgctcaagccgcgctacgagaacatcgcgcagtcccaggcgttcttcggcaagttcgacaagatctgctacaacaccgacaagggctacttcgagttccacatcgactacgcgaagttcaccgacaaggccaagaactccaggcagaagtgggccatctgcagccacggcgacaagcgctacgtgtacgacaagacggcgaaccagaacaagggcgcggccaagggcatcaacgtgaacgacgagctgaagtccctcttcgcgcgctaccacatcaacgacaagcagccgaacctcgtcatggacatctgccagaacaacgacaaggagttccacaagagcctgatgtgcctgctcaagaccctgctcgccctccgctactccaacgcgagctccgacgaggacttcatcctcagccccgtcgcgaacgacgagggcgtgttcttcaactccgccctcgcggacgacacgcagccgcagaacgccgacgcgaacggcgcctaccacatcgccctcaagggcctgtggctgctcaacgagctcaagaactccgacgacctgaacaaggtgaagctcgccattgacaaccagacgtggctgaatttcgctcagaataggccgaagaagaagcgcaaggtgtccggcggcagctccggcggcagcccgaagaagaagcgcaaagtgtga

SEQ ID NO: 43 - protein, 1311 aa, Artificial Sequence
  Fusion protein
MPKKKRKVGGGGSGGGGSGGGGSGGGGSGGGGSGGGGSMLFQDFTHLYPLSKTVRFELKPIGRTLEHIHAKNFLSQDETMADMYQKVKVILDDYHRDFIADMMGEVKLTKLAEFYDVYLKFRKNPKDDGLQKQLKDLQAVLRKESVKPIGSGGKYKTGYDRLFGAKLFKDGKELGDLAKFVIAQEGESSPKLAHLAHFEKFSTYFTGFHDNRKNMYSDEDKHTAIAYRLIHENLPRFIDNLQILTTIKQKHSALYDQIINELTASGLDVSLASHLDGYHKLLTQEGITAYNRIIGEVNGYTNKHNQICHKSERIAKLRPLHKQILSDGMGVSFLPSKFADDSEMCQAVNEFYRHYTDVFAKVQSLFDGFDDHQKDGIYVEHKNLNELSKQAFGDFALLGRVLDGYYVDVVNPEFNERFAKAKTDNAKAKLTKEKDKFIKGVHSLASLEQAIEHHTARHDDESVQAGKLGQYFKHGLAGVDNPIQKIHNNHSTIKGFLERERPAGERALPKIKSGKNPEMTQLRQLKELLDNALNVAHFAKLLTTKTTLDNQDGNFYGEFGVLYDELAKIPTLYNKVRDYLSQKPFSTEKYKLNFGNPTLLNGWDLNKEKDNFGVILQKDGCYYLALLDKAHKKVFDNAPNTGKNVYQKMVYKLLPGPNKMLPKVFFAKSNLDYYNPSAELLDKYAKGTHKKGDNFNLKDCHALIDFFKAGINKHPEWQHFGFKFSPTSSYRDLSDFYREVEPQGYQVKFVDINADYIDELVEQGKLYLFQIYNKDFSPKAHGKPNLHTLYFKALFSEDNLADPIYKLNGEAQIFYRKASLDMNETTIHRAGEVLENKNPDNPKKRQFVYDIIKDKRYTQDKFMLHVPITMNFGVQGMTIKEFNKKVNQSIQQYDEVNVIGIDRGERHLLYLTVINSKGEILEQRSLNDITTASANGTQVTTPYHKILDKREIERLNARVGWGEIETIKELKSGYLSHVVHQINQLMLKYNAIVVLEDLNFGFKRGRFKVEKQIYQNFENALIKKLNHLVLKDKADDEIGSYKNALQLTNNFTDLKSIGKQTGFLFYVPAWNTSKIDPETGFVDLLKPRYENIAQSQAFFGKFDKICYNTDKGYFEFHIDYAKFTDKAKNSRQKWAICSHGDKRYVYDKTANQNKGAAKGINVNDELKSLFARYHINDKQPNLVMDICQNNDKEFHKSLMCLLKTLLALRYSNASSDEDFILSPVANDEGVFFNSALADDTQPQNADANGAYHIALKGLWLLNELKNSDDLNKVKLAIDNQTWLNFAQNRPKKKRKVSGGSSGGSPKKKRKV

SEQ ID NO: 44 - protein, 36 aa, Artificial Sequence
  Synthetic
GGGGSGGGGGSGGGGGSGGGGGSGGGGGSGGGGGSG

SEQ ID NO: 45 - protein, 1260 aa, Artificial Sequence; identical to SEQ ID NO: 33
  Synthetic
  xNLS-03 (1)..(9)
  xEpitope-03 (10)..(17)
  xNLS-04 (1245)..(1260)

SEQ ID NO: 46 - protein, 1283 aa, Artificial Sequence; identical to SEQ ID NO: 41
  Synthetic
  xNLS-03 (1)..(9)
  xEpitope-03 (10)..(17)
  xNLS-04 (1268)..(1283)

SEQ ID NO: 47 - protein, 1352 aa, Artificial Sequence
  Synthetic
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRNKRPAATKKAGQAKKKKGSYPYDVPDYAYPYDVPDYAYPYDVPDYA

SEQ ID NO: 48 - protein, 1387 aa, Artificial Sequence
  Synethtic
  xSV40NLS-06 (2)..(8)
  xLinker-06 (9)..(39)
  xSV40NLS-04 (1339)..(1345)
  xsGGSlinker-02 (1346)..(1349)
  xsGGSlinker-02 (1350)..(1353)
  xSV40NLS-07 (1354)..(1360)
  tag3XHA (1361)..(1387)
MPKKKRKVGGGGSGGGGSGGGGSGGGGSGGGGSGGGGSMSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIDRGERHLAYYTLVDGKGNIIKQDTFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLGRIKNNQEGKKLNLVIKNEEYFEFVQNRNNPKKKRKVSGGSSGGSPKKKRKVYPYDVPDYAYPYDVPDYAYPYDVPDYA

SEQ ID NO: 49 - DNA, 4899 bp, Artificial Sequence
  Synthetic
atgccgaagaagaagcgcaaggtcatgtccagcgagaccggccccgtggcggtggaccccaccctgcgcaggcgcatcgagccgcacgagttcgaggtgttcttcgaccccagggagctccgcaaggagacctgcctcctgtacgagatcaactggggcggcaggcactccatctggaggcacacgagccagaacaccaacaagcacgtcgaggtgaacttcatcgagaagttcaccacggagaggtacttctgcccgaacacgcgctgctccatcacgtggttcctctcgtggagcccatgcggcgagtgctccagggcgatcacggagttcctcagccgctacccgcacgtgaccctgttcatctacatcgctaggctctaccaccacgcggaccccaggaacaggcagggcctcagggacctgatctccagcggcgtcacgatccagatcatgaccgagcaggagtccggctactgctggaggaacttcgtgaactactccccgagcaacgaggcccactggccccgctacccgcacctctgggtccgcctctacgtgctcgagctgtactgcatcatcctcggcctgccgccctgcctcaacatcctgaggcgcaagcagccccagctgacgttcttcaccatcgccctgcagagctgccactaccagaggctcccgccccacatcctgtgggcgaccgggctcaaggggggcgggggctcaggcgggggcgggagcggcggcgggggctctgggggcggcggcagcggcgggggcggcagcgggggcggcgggtcgatgctcttccaggacttcacccacctctacccgctgtccaagacggtgaggttcgagctgaagcccatcggccgcaccctcgagcacatccacgccaagaacttcctcagccaggacgagacgatggcggacatgtaccagaaggtgaaggtcatcctggacgactaccacagggacttcatcgccgacatgatgggcgaggtgaagctcaccaagctggcggagttctacgacgtctacctgaagttccgcaagaacccgaaggacgacggcctccagaagcagctcaaggacctgcaggccgtgctgaggaaggagtcggtcaagccaatcggcagcggcggcaagtacaagaccggctacgacaggctgttcggcgccaagctcttcaaggacggcaaggagctcggcgacctggccaagttcgtgatcgcccaggagggcgagtcctcgcccaagctcgctcacctggcccacttcgagaagttctccacctacttcacgggcttccacgacaaccgcaagaacatgtacagcgacgaggacaagcacaccgccatcgcgtacaggctgatccacgagaacctcccccgcttcatcgacaacctccagatcctgaccacgatcaagcagaagcactccgccctgtacgaccagatcatcaacgagctgacggcttcgggcctggacgtgtccctggccagccacctcgacggctaccacaagctcctgacccaggagggcatcacggcctacaacaggatcatcggcgaggtcaacggctacacgaacaagcacaaccagatctgccacaagtcggagaggatcgccaagctcaggcccctgcacaagcagatcctgagcgacggcatgggcgtgtccttcctccccagcaagttcgccgacgactccgagatgtgccaggcggtcaacgagttctaccgccactacaccgacgtgttcgccaaggtccagagcctgttcgacggcttcgacgaccaccagaaggacggcatctacgtggagcacaagaacctcaacgagctgtccaagcaggccttcggcgacttcgccctcctgggcagggtgctggacggctactacgtcgacgtggtcaacccggagttcaacgagcgcttcgccaaggcgaagaccgacaacgccaaggcgaagctgacgaaggagaaggacaagttcatcaagggcgtccactcgctggccagcctggagcaggccatcgagcaccacacggctaggcacgacgacgagtcggtgcaggccggcaagctgggccagtacttcaagcacggcctggcgggcgtggacaacccgatccagaagatccacaacaaccactccaccatcaagggcttcctcgagagggagaggcccgcgggcgagagggcgctgcccaagatcaagagcggcaagaaccccgagatgacgcagctccgccagctgaaggagctcctggacaacgccctcaacgtggcccacttcgcgaagctcctgaccacgaagaccacgctggacaaccaggacggcaacttctacggcgagttcggcgtgctgtacgacgagctcgcgaagatcccgaccctgtacaacaaggtccgcgactacctctcccagaagccgttcagcaccgagaagtacaagctcaacttcggcaaccccacgctcctgaacggctgggacctgaacaaggagaaggacaacttcggcgtgatcctgcagaaggacggctgctactacctcgccctcctggacaaggcgcacaagaaggtcttcgacaacgcccccaacacgggcaagaacgtgtaccagaagatggtctacaagctcctgccgggccccaacaagatgctgccgaaggtgttcttcgcgaagtccaacctcgactactacaaccccagcgccgagctcctggacaagtacgcgaagggcacccacaagaagggcgacaacttcaacctgaaggactgccacgccctcatcgacttcttcaaggcgggcatcaacaagcacccggagtggcagcacttcggcttcaagttctcccccacgtccagctacagggacctcagcgacttctacagggaggtggagccccagggctaccaggtgaagttcgtcgacatcaacgccgactacatcgacgagctggtcgagcagggcaagctctacctgttccagatctacaacaaggacttctcgcccaaggcccacggcaagccaaacctccacaccctgtacttcaaggccctgttcagcgaggacaacctcgcggaccccatctacaagctcaacggcgaggcccagatcttctacaggaaggcgtccctggacatgaacgagacgaccatccacagggcgggcgaggtgctcgagaacaagaacccggacaaccccaagaagaggcagttcgtctacgacatcatcaaggacaagcgctacacgcaggacaagttcatgctgcacgtgccgatcaccatgaacttcggcgtccagggcatgacgatcaaggagttcaacaagaaggtgaaccagtccatccagcagtacgacgaggtgaacgtcatcggcatcgctcgcggcgagaggcacctcctgtacctcaccgtcatcaacagcaagggcgagatcctggagcagaggtccctcaacgacatcacgaccgcttcggccaacggcacgcaggtgaccacgccctaccacaagatcctggacaagcgcgagatcgagaggctcaacgctagggtgggctggggcgagatcgagaccatcaaggagctgaagtccggctacctcagccacgtggtccaccagatcaaccagctcatgctgaagtacaacgccatcgtggtcctcgcggacctgaatttcggcttcaagcgcggcaggttcaaggtggagaagcagatctaccagaacttcgagaacgccctgatcaagaagctcaaccacctcgtcctgaaggacaaggccgacgacgagatcggctcctacaagaacgcgctccagctgaccaacaacttcacggacctgaagagcatcggcaagcagaccggcttcctcttctacgtgccggcgtggaacacctccaagatcgaccccgagacgggcttcgtcgacctcctgaagccgaggtacgagaacatcgcccagagccaggcgttcttcggcaagttcgacaagatctgctacaacaccgacaagggctacttcgagttccacatcgactacgccaagttcacggacaaggcgaagaactccaggcagaagtgggccatctgcagccacggcgacaagcgctacgtgtacgacaagaccgcgaaccagaacaagggcgccgcgaagggcatcaacgtcaacgacgagctcaagtccctgttcgcccgctaccacatcaacgacaagcagccgaacctcgtgatggacatctgccagaacaacgacaaggagttccacaagagcctgatgtgcctcctgaagaccctcctggccctccgctactccaacgcctccagcgacgaggcgttcatcctgagccccgtggccaacgacgagggcgtcttcttcaactcggctctggccgacgacacccagccacagaacgcggacgccaacggcgcttaccacatcgcgctcaagggcctgtggctcctgaacgagctcaagaacagcgacgacctgaacaaggtcaagctcgccatcgacaaccagacctggctgaacttcgcccagaaccgcaagaggcccgcggccacgaagaaggcgggccaggccaagaagaagaagtccggcggcagcacgaacctgtccgacatcatcgagaaggagaccggcaagcagctcgtgatccaggagagcatcctcatgctgccggaggaggtcgaggaggtcatcggcaacaagcccgagtccgacatcctcgtccacacggcctacgacgagtccaccgacgagaacgtgatgctcctgacctcggacgctcccgagtacaagccatgggccctggtcatccaggacagcaacggcgagaacaagatcaagatgctctccggcggcagcccgaagaagaagcgcaaagtgtga

SEQ ID NO: 50 - protein, 1632 aa, Artificial Sequence
  Fusion protein
MPKKKRKVMSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQLTFFTIALQSCHYQRLPPHILWATGLKGGGGSGGGGSGGGGSGGGGSGGGGSGGGGSMLFQDFTHLYPLSKTVRFELKPIGRTLEHIHAKNFLSQDETMADMYQKVKVILDDYHRDFIADMMGEVKLTKLAEFYDVYLKFRKNPKDDGLQKQLKDLQAVLRKESVKPIGSGGKYKTGYDRLFGAKLFKDGKELGDLAKFVIAQEGESSPKLAHLAHFEKFSTYFTGFHDNRKNMYSDEDKHTAIAYRLIHENLPRFIDNLQILTTIKQKHSALYDQIINELTASGLDVSLASHLDGYHKLLTQEGITAYNRIIGEVNGYTNKHNQICHKSERIAKLRPLHKQILSDGMGVSFLPSKFADDSEMCQAVNEFYRHYTDVFAKVQSLFDGFDDHQKDGIYVEHKNLNELSKQAFGDFALLGRVLDGYYVDVVNPEFNERFAKAKTDNAKAKLTKEKDKFIKGVHSLASLEQAIEHHTARHDDESVQAGKLGQYFKHGLAGVDNPIQKIHNNHSTIKGFLERERPAGERALPKIKSGKNPEMTQLRQLKELLDNALNVAHFAKLLTTKTTLDNQDGNFYGEFGVLYDELAKIPTLYNKVRDYLSQKPFSTEKYKLNFGNPTLLNGWDLNKEKDNFGVILQKDGCYYLALLDKAHKKVFDNAPNTGKNVYQKMVYKLLPGPNKMLPKVFFAKSNLDYYNPSAELLDKYAKGTHKKGDNFNLKDCHALIDFFKAGINKHPEWQHFGFKFSPTSSYRDLSDFYREVEPQGYQVKFVDINADYIDELVEQGKLYLFQIYNKDFSPKAHGKPNLHTLYFKALFSEDNLADPIYKLNGEAQIFYRKASLDMNETTIHRAGEVLENKNPDNPKKRQFVYDIIKDKRYTQDKFMLHVPITMNFGVQGMTIKEFNKKVNQSIQQYDEVNVIGIARGERHLLYLTVINSKGEILEQRSLNDITTASANGTQVTTPYHKILDKREIERLNARVGWGEIETIKELKSGYLSHVVHQINQLMLKYNAIVVLADLNFGFKRGRFKVEKQIYQNFENALIKKLNHLVLKDKADDEIGSYKNALQLTNNFTDLKSIGKQTGFLFYVPAWNTSKIDPETGFVDLLKPRYENIAQSQAFFGKFDKICYNTDKGYFEFHIDYAKFTDKAKNSRQKWAICSHGDKRYVYDKTANQNKGAAKGINVNDELKSLFARYHINDKQPNLVMDICQNNDKEFHKSLMCLLKTLLALRYSNASSDEAFILSPVANDEGVFFNSALADDTQPQNADANGAYHIALKGLWLLNELKNSDDLNKVKLAIDNQTWLNFAQNRKRPAATKKAGQAKKKKSGGSTNLSDIIEKETGKQLVIQESILMLPEEVEEVIGNKPESDILVHTAYDESTDENVMLLTSDAPEYKPWALVIQDSNGENKIKMLSGGSPKKKRKV

SEQ ID NO: 51 - DNA, 4809 bp, Artificial Sequence
  Synthetic
atgccgaagaagaagcgcaaggtcatgtccagcgagaccggccccgtggcggtggaccccaccctgcgcaggcgcatcgagccgcacgagttcgaggtgttcttcgaccccagggagctccgcaaggagacctgcctcctgtacgagatcaactggggcggcaggcactccatctggaggcacacgagccagaacaccaacaagcacgtcgaggtgaacttcatcgagaagttcaccacggagaggtacttctgcccgaacacgcgctgctccatcacgtggttcctctcgtggagcccatgcggcgagtgctccagggcgatcacggagttcctcagccgctacccgcacgtgaccctgttcatctacatcgctaggctctaccaccacgcggaccccaggaacaggcagggcctcagggacctgatctccagcggcgtcacgatccagatcatgaccgagcaggagtccggctactgctggaggaacttcgtgaactactccccgagcaacgaggcccactggccccgctacccgcacctctgggtccgcctctacgtgctcgagctgtactgcatcatcctcggcctgccgccctgcctcaacatcctgaggcgcaagcagccccagctgacgttcttcaccatcgccctgcagagctgccactaccagaggctcccgccccacatcctgtgggcgaccgggctcaaggggggcgggggctcaggcgggggcgggagcggcggcgggggctctgggggcggcggcagcggcgggggcggcagcgggggcggcgggtcgatgagcaagctggagaagttcacgaactgctactccctcagcaagaccctgaggttcaaggcgatcccggtcggcaagacccaggagaacatcgacaacaagcggctgctggtggaggacgagaagagggctgaggactacaagggcgtgaagaagctcctggaccgctactacctgtccttcatcaacgacgtgctccacagcatcaagctcaagaacctgaacaactacatcagcctcttcaggaagaagacgcgcaccgagaaggagaacaaggagctcgagaacctggagatcaacctgaggaaggagatcgccaaggcgttcaagggcaacgagggctacaagtccctcttcaagaaggacatcatcgagacgatcctcccggagttcctggacgacaaggacgagatcgccctggtcaactccttcaacggcttcaccacggcgttcaccggcttcttcgacaaccgcgagaacatgttcagcgaggaggccaagtccacgagcatcgcgttcaggtgcatcaacgagaacctcacccgctacatctccaacatggacatcttcgagaaggtcgacgcgatcttcgacaagcacgaggtgcaggagatcaaggagaagatcctgaacagcgactacgacgtcgaggacttcttcgagggcgagttcttcaacttcgtcctcacgcaggagggcatcgacgtgtacaacgccatcatcggtggcttcgtgaccgagtccggcgagaagatcaagggcctgaacgagtacatcaacctctacaaccagaagaccaagcagaagctgccgaagttcaagcccctgtacaagcaggtgctctccgacagggagtccctcagcttctacggcgagggctacacgagcgacgaggaggtcctggaggtgttccgcaacaccctcaacaagaacagcgagatcttctccagcatcaagaagctcgagaagctgttcaagaacttcgacgagtactccagcgccggcatcttcgtcaagaacggcccggcgatctccacgatcagcaaggacatcttcggcgagtggaacgtgatccgcgacaagtggaacgccgagtacgacgacatccacctcaagaagaaggcggtggtcaccgagaagtacgaggacgacaggcgcaagtccttcaagaagatcggctccttcagcctcgagcagctgcaggagtacgccgacgcggacctgagcgtggtcgagaagctcaaggagatcatcatccagaaggtcgacgagatctacaaggtgtacggctccagcgagaagctcttcgacgcggacttcgtcctcgagaagtccctgaagaagaacgacgccgtggtcgcgatcatgaaggacctcctggactccgtgaagagcttcgagaattacatcaaggccttcttcggcgagggcaaggagacgaacagggacgagtccttctacggcgacttcgtcctggcctacgacatcctcctgaaggtggaccacatctacgacgcgatccgcaactacgtgacccagaagccgtacagcaaggacaagttcaagctctacttccagaacccccagttcatgggcggctgggacaaggacaaggagacggactacagggcgaccatcctgcgctacggcagcaagtactacctcgccatcatggacaagaagtacgcgaagtgcctgcagaagatcgacaaggacgacgtcaacggcaactacgagaagatcaactacaagctcctgccgggccccaacaagatgctcccgaaggtgttcttctccaagaagtggatggcctactacaaccccagcgaggacatccagaagatctacaagaacggcacgttcaagaagggcgacatgttcaacctgaacgactgccacaagctcatcgacttcttcaaggactccatcagccgctacccgaagtggtccaacgcctacgacttcaacttcagcgagaccgagaagtacaaggacatcgcgggcttctaccgcgaggtcgaggagcagggctacaaggtgtccttcgagtccgccagcaagaaggaggtcgacaagctggtggaggagggcaagctctacatgttccagatctacaacaaggacttctccgacaagagccacggcacgcccaacctgcacaccatgtacttcaagctcctgttcgacgagaacaaccacggccagatcaggctgtccggcggcgccgagctcttcatgaggagggcgagcctgaagaaggaggagctggtggtccaccccgctaacagcccaatcgcgaacaagaacccggacaaccccaagaagaccacgaccctgtcctacgacgtgtacaaggacaagaggttcagcgaggaccagtacgagctccacatcccgatcgcgatcaacaagtgccccaagaacatcttcaagatcaacaccgaggtccgcgtgctcctgaagcacgacgacaacccctacgtgatcggcatcgacaggggcgagaggaacctcctgtacatcgtggtcgtggacggcaagggcaacatcgtggagcagtactccctcaacgagatcatcaacaacttcaacggcatcaggatcaagacggactaccacagcctcctggacaagaaggagaaggagaggttcgaggcccgccagaactggacctccatcgagaacatcaaggagctgaaggcgggctacatcagccaggtcgtgcacaagatctgcgagctcgtcgagaagtacgacgccgtgatcgccctcgaggacctgaactccggcttcaagaacagccgcgtcaaggtggagaagcaggtctaccagaagttcgagaagatgctcatcgacaagctgaactacatggtggacaagaagtccaacccctgcgctacgggcggcgcgctgaagggctaccagatcaccaacaagttcgagagcttcaagtccatgagcactcagaacggcttcatcttctacatcccggcgtggctcacgtccaagatcgaccccagcaccggcttcgtcaacctcctgaagacgaagtacacctccatcgccgacagcaagaagttcatctccagcttcgaccgcatcatgtatgtgccggaggaggacctgttcgagttcgccctcgactacaagaacttctcccgcacggacgcggactacatcaagaagtggaagctgtacagctacggcaaccgcatccgcatcttcaggaaccccaagaagaacaacgtcttcgactgggaggaggtgtgcctgacctccgcgtacaaggagctcttcaacaagtacggcatcaactaccagcagggcgacatcagggctctcctgtgcgagcagagcgacaaggccttctactccagcttcatggcgctgatgtccctcatgctgcagatgaggaactcgatcaccggcaggacggacgtggacttcctcatctccccggtgaagaacagcgacggcatcttctacgactccaggaactacgaggcccaggagaacgcgatcctcccaaagaacgcggacgccaacggcgcctacaacatcgccaggaaggtcctctgggctatcggccagttcaagaaggcggaggacgagaagctggacaaggtgaagatcgccatcagcaacaaggagtggctcgagtacgcccagacctcggtcaagcacggcagcccgaagaagaagcgcaaggtgtccggcggcagcacgaacctgtccgacatcatcgagaaggagaccggcaagcagctcgtgatccaggagagcatcctcatgctgccggaggaggtcgaggaggtcatcggcaacaagcccgagtccgacatcctcgtccacacggcctacgacgagtccaccgacgagaacgtgatgctcctgacctcggacgctcccgagtacaagccatgggccctggtcatccaggacagcaacggcgagaacaagatcaagatgctctccggcggcagcccgaagaagaagcgcaaagtgtga

SEQ ID NO: 52 - protein, 1602 aa, Artificial Sequence
  Fusion protein
MPKKKRKVMSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQLTFFTIALQSCHYQRLPPHILWATGLKGGGGSGGGGSGGGGSGGGGSGGGGSGGGGSMSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHGSPKKKRKVSGGSTNLSDIIEKETGKQLVIQESILMLPEEVEEVIGNKPESDILVHTAYDESTDENVMLLTSDAPEYKPWALVIQDSNGENKIKMLSGGSPKKKRKV

SEQ ID NO: 53 - DNA, 3873 bp, Artificial Sequence; identical to SEQ ID NO: 34
  Synthetic

SEQ ID NO: 54 - protein, 1290 aa, Artificial Sequence; identical to SEQ ID NO: 35
  Fusion protein

SEQ ID NO: 55 - DNA, 3873 bp, Artificial Sequence; identical to SEQ ID NO: 34
  Synthetic

SEQ ID NO: 56 - protein, 1290 aa, Artificial Sequence; identical to SEQ ID NO: 35
  Fusion protein

SEQ ID NO: 57 - protein, 1491 aa, Artificial Sequence
  Synthetic
GGGGSGGGGGSGGGGGSGGGGGSGGGGGSGGGGGSGMSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQLTFFTIALQSCHYQRLPPHILWATGLKGGGGSGGGGSGGGGSGGGGSGGGGSGGGGSMSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIARGERNLLYIVVVDGKGNIVEQYSLNEIINNFNGIRIKTDYHSLLDKKEKERFEARQNWTSIENIKELKAGYISQVVHKICELVEKYDAVIALADLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVAFLISPVKNSDGIFYDSRNYEAQENAILPKNADANGAYNIARKVLWAIG

SEQ ID NO: 58 - protein, 1662 aa, Artificial Sequence
  Synthetic
GGGGSGGGGSGGGGSGGGGSGGGGSGGGGSMPKKKRKVMSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQLTFFTIALQSCHYQRLPPHILWATGLKGGGGSGGGGSGGGGSGGGGSGGGGSGGGGSMLFQDFTHLYPLSKTVRFELKPIGRTLEHIHAKNFLSQDETMADMYQKVKVILDDYHRDFIADMMGEVKLTKLAEFYDVYLKFRKNPKDDGLQKQLKDLQAVLRKESVKPIGSGGKYKTGYDRLFGAKLFKDGKELGDLAKFVIAQEGESSPKLAHLAHFEKFSTYFTGFHDNRKNMYSDEDKHTAIAYRLIHENLPRFIDNLQILTTIKQKHSALYDQIINELTASGLDVSLASHLDGYHKLLTQEGITAYNRIIGEVNGYTNKHNQICHKSERIAKLRPLHKQILSDGMGVSFLPSKFADDSEMCQAVNEFYRHYTDVFAKVQSLFDGFDDHQKDGIYVEHKNLNELSKQAFGDFALLGRVLDGYYVDVVNPEFNERFAKAKTDNAKAKLTKEKDKFIKGVHSLASLEQAIEHHTARHDDESVQAGKLGQYFKHGLAGVDNPIQKIHNNHSTIKGFLERERPAGERALPKIKSGKNPEMTQLRQLKELLDNALNVAHFAKLLTTKTTLDNQDGNFYGEFGVLYDELAKIPTLYNKVRDYLSQKPFSTEKYKLNFGNPTLLNGWDLNKEKDNFGVILQKDGCYYLALLDKAHKKVFDNAPNTGKNVYQKMVYKLLPGPNKMLPKVFFAKSNLDYYNPSAELLDKYAKGTHKKGDNFNLKDCHALIDFFKAGINKHPEWQHFGFKFSPTSSYRDLSDFYREVEPQGYQVKFVDINADYIDELVEQGKLYLFQIYNKDFSPKAHGKPNLHTLYFKALFSEDNLADPIYKLNGEAQIFYRKASLDMNETTIHRAGEVLENKNPDNPKKRQFVYDIIKDKRYTQDKFMLHVPITMNFGVQGMTIKEFNKKVNQSIQQYDEVNVIGIARGERHLLYLTVINSKGEILEQRSLNDITTASANGTQVTTPYHKILDKREIERLNARVGWGEIETIKELKSGYLSHVVHQINQLMLKYNAIVVLADLNFGFKRGRFKVEKQIYQNFENALIKKLNHLVLKDKADDEIGSYKNALQLTNNFTDLKSIGKQTGFLFYVPAWNTSKIDPETGFVDLLKPRYENIAQSQAFFGKFDKICYNTDKGYFEFHIDYAKFTDKAKNSRQKWAICSHGDKRYVYDKTANQNKGAAKGINVNDELKSLFARYHINDKQPNLVMDICQNNDKEFHKSLMCLLKTLLALRYSNASSDEAFILSPVANDEGVFFNSALADDTQPQNADANGAYHIALKGLWLLNELKNSDDLNKVKLAIDNQTWLNFAQNRKRPAATKKAGQAKKKKSGGSTNLSDIIEKETGKQLVIQESILMLPEEVEEVIGNKPESDILVHTAYDESTDENVMLLTSDAPEYKPWALVIQDSNGENKIKMLSGGSPKKKRKV

SEQ ID NO: 59 - protein, 1267 aa, Artificial Sequence
  Synthetic
SGSETPGTSESATPESMLFQDFTHLYPLSKTVRFELKPIGRTLEHIHAKNFLSQDETMADMYQKVKVILDDYHRDFIADMMGEVKLTKLAEFYDVYLKFRKNPKDDGLQKQLKDLQAVLRKESVKPIGSGGKYKTGYDRLFGAKLFKDGKELGDLAKFVIAQEGESSPKLAHLAHFEKFSTYFTGFHDNRKNMYSDEDKHTAIAYRLIHENLPRFIDNLQILTTIKQKHSALYDQIINELTASGLDVSLASHLDGYHKLLTQEGITAYNRIIGEVNGYTNKHNQICHKSERIAKLRPLHKQILSDGMGVSFLPSKFADDSEMCQAVNEFYRHYTDVFAKVQSLFDGFDDHQKDGIYVEHKNLNELSKQAFGDFALLGRVLDGYYVDVVNPEFNERFAKAKTDNAKAKLTKEKDKFIKGVHSLASLEQAIEHHTARHDDESVQAGKLGQYFKHGLAGVDNPIQKIHNNHSTIKGFLERERPAGERALPKIKSGKNPEMTQLRQLKELLDNALNVAHFAKLLTTKTTLDNQDGNFYGEFGVLYDELAKIPTLYNKVRDYLSQKPFSTEKYKLNFGNPTLLNGWDLNKEKDNFGVILQKDGCYYLALLDKAHKKVFDNAPNTGKNVYQKMVYKLLPGPNKMLPKVFFAKSNLDYYNPSAELLDKYAKGTHKKGDNFNLKDCHALIDFFKAGINKHPEWQHFGFKFSPTSSYRDLSDFYREVEPQGYQVKFVDINADYIDELVEQGKLYLFQIYNKDFSPKAHGKPNLHTLYFKALFSEDNLADPIYKLNGEAQIFYRKASLDMNETTIHRAGEVLENKNPDNPKKRQFVYDIIKDKRYTQDKFMLHVPITMNFGVQGMTIKEFNKKVNQSIQQYDEVNVIGIDRGERHLLYLTVINSKGEILEQRSLNDITTASANGTQVTTPYHKILDKREIERLNARVGWGEIETIKELKSGYLSHVVHQINQLMLKYNAIVVLEDLNFGFKRGRFKVEKQIYQNFENALIKKLNHLVLKDKADDEIGSYKNALQLTNNFTDLKSIGKQTGFLFYVPAWNTSKIDPETGFVDLLKPRYENIAQSQAFFGKFDKICYNTDKGYFEFHIDYAKFTDKAKNSRQKWAICSHGDKRYVYDKTANQNKGAAKGINVNDELKSLFARYHINDKQPNLVMDICQNNDKEFHKSLMCLLKTLLALRYSNASSDEDFILSPVANDEGVFFNSALADDTQPQNADANGAYHIALKGLWLLNELKNSDDLNKVKLAIDNQTWLNFAQNR

SEQ ID NO: 60 - protein, 1368 aa, Artificial Sequence
  Synthetic
SGSETPGTSESATPESMTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRNKRPAATKKAGQAKKKKGSYPYDVPDYAYPYDVPDYAYPYDVPDYA

SEQ ID NO: 61 - protein, 1332 aa, Artificial Sequence
  Synthetic
SGSETPGTSESATPESMTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIARGERNLIYITVIDSTGKILEQRSLNTIQQFDYQKKLDNREKERVAARQAWSVVGTIKDLKQGYLSQVIHEIVDLMIHYQAVVVLANLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEAYINSPVRDLNGVCFDSRFQNPEWPMDADANGAYHIALKGQLLLNHLKESKDLKLQNGISNQDWLAYIQELRNGSPKKKRKV

SEQ ID NO: 62 - protein, 1403 aa, Artificial Sequence
  Synthetic
SGSETPGTSESATPESMPKKKRKVGGGGSGGGGSGGGGSGGGGSGGGGSGGGGSMSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIDRGERHLAYYTLVDGKGNIIKQDTFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLGRIKNNQEGKKLNLVIKNEEYFEFVQNRNNPKKKRKVSGGSSGGSPKKKRKVYPYDVPDYAYPYDVPDYAYPYDVPDYA

SEQ ID NO: 63 - protein, 1382 aa, Artificial Sequence
  Synthetic
GGGGSGGGGSGGGGSGGGGSGGGGSGGGGSMTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRNKRPAATKKAGQAKKKKGSYPYDVPDYAYPYDVPDYAYPYDVPDYA

SEQ ID NO: 64 - protein, 1346 aa, Artificial Sequence
  Synthetic
GGGGSGGGGSGGGGSGGGGSGGGGSGGGGSMTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIARGERNLIYITVIDSTGKILEQRSLNTIQQFDYQKKLDNREKERVAARQAWSVVGTIKDLKQGYLSQVIHEIVDLMIHYQAVVVLANLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEAYINSPVRDLNGVCFDSRFQNPEWPMDADANGAYHIALKGQLLLNHLKESKDLKLQNGISNQDWLAYIQELRNGSPKKKRKV

SEQ ID NO: 65 - protein, 1417 aa, Artificial Sequence
  Synthetic
GGGGSGGGGSGGGGSGGGGSGGGGSGGGGSMPKKKRKVGGGGSGGGGSGGGGSGGGGSGGGGSGGGGSMSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIDRGERHLAYYTLVDGKGNIIKQDTFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLGRIKNNQEGKKLNLVIKNEEYFEFVQNRNNPKKKRKVSGGSSGGSPKKKRKVYPYDVPDYAYPYDVPDYAYPYDVPDYA

SEQ ID NO: 66 - protein, 1287 aa, Artificial Sequence
  Syntheti
GGGGSGGGGGSGGGGGSGGGGGSGGGGGSGGGGGSGMLFQDFTHLYPLSKTVRFELKPIGRTLEHIHAKNFLSQDETMADMYQKVKVILDDYHRDFIADMMGEVKLTKLAEFYDVYLKFRKNPKDDGLQKQLKDLQAVLRKESVKPIGSGGKYKTGYDRLFGAKLFKDGKELGDLAKFVIAQEGESSPKLAHLAHFEKFSTYFTGFHDNRKNMYSDEDKHTAIAYRLIHENLPRFIDNLQILTTIKQKHSALYDQIINELTASGLDVSLASHLDGYHKLLTQEGITAYNRIIGEVNGYTNKHNQICHKSERIAKLRPLHKQILSDGMGVSFLPSKFADDSEMCQAVNEFYRHYTDVFAKVQSLFDGFDDHQKDGIYVEHKNLNELSKQAFGDFALLGRVLDGYYVDVVNPEFNERFAKAKTDNAKAKLTKEKDKFIKGVHSLASLEQAIEHHTARHDDESVQAGKLGQYFKHGLAGVDNPIQKIHNNHSTIKGFLERERPAGERALPKIKSGKNPEMTQLRQLKELLDNALNVAHFAKLLTTKTTLDNQDGNFYGEFGVLYDELAKIPTLYNKVRDYLSQKPFSTEKYKLNFGNPTLLNGWDLNKEKDNFGVILQKDGCYYLALLDKAHKKVFDNAPNTGKNVYQKMVYKLLPGPNKMLPKVFFAKSNLDYYNPSAELLDKYAKGTHKKGDNFNLKDCHALIDFFKAGINKHPEWQHFGFKFSPTSSYRDLSDFYREVEPQGYQVKFVDINADYIDELVEQGKLYLFQIYNKDFSPKAHGKPNLHTLYFKALFSEDNLADPIYKLNGEAQIFYRKASLDMNETTIHRAGEVLENKNPDNPKKRQFVYDIIKDKRYTQDKFMLHVPITMNFGVQGMTIKEFNKKVNQSIQQYDEVNVIGIDRGERHLLYLTVINSKGEILEQRSLNDITTASANGTQVTTPYHKILDKREIERLNARVGWGEIETIKELKSGYLSHVVHQINQLMLKYNAIVVLEDLNFGFKRGRFKVEKQIYQNFENALIKKLNHLVLKDKADDEIGSYKNALQLTNNFTDLKSIGKQTGFLFYVPAWNTSKIDPETGFVDLLKPRYENIAQSQAFFGKFDKICYNTDKGYFEFHIDYAKFTDKAKNSRQKWAICSHGDKRYVYDKTANQNKGAAKGINVNDELKSLFARYHINDKQPNLVMDICQNNDKEFHKSLMCLLKTLLALRYSNASSDEDFILSPVANDEGVFFNSALADDTQPQNADANGAYHIALKGLWLLNELKNSDDLNKVKLAIDNQTWLNFAQNR

SEQ ID NO: 67 - protein, 1388 aa, Artificial Sequence
  Synthetic
GGGGSGGGGGSGGGGGSGGGGGSGGGGGSGGGGGSGMTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRNKRPAATKKAGQAKKKKGSYPYDVPDYAYPYDVPDYAYPYDVPDYA

SEQ ID NO: 68 - protein, 1352 aa, Artificial Sequence
  Syntheti
GGGGSGGGGGSGGGGGSGGGGGSGGGGGSGGGGGSGMTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIARGERNLIYITVIDSTGKILEQRSLNTIQQFDYQKKLDNREKERVAARQAWSVVGTIKDLKQGYLSQVIHEIVDLMIHYQAVVVLANLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEAYINSPVRDLNGVCFDSRFQNPEWPMDADANGAYHIALKGQLLLNHLKESKDLKLQNGISNQDWLAYIQELRNGSPKKKRKV

SEQ ID NO: 69 - protein, 1423 aa, Artificial Sequence
  Synthetic
GGGGSGGGGGSGGGGGSGGGGGSGGGGGSGGGGGSGMPKKKRKVGGGGSGGGGSGGGGSGGGGSGGGGSGGGGSMSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIDRGERHLAYYTLVDGKGNIIKQDTFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLGRIKNNQEGKKLNLVIKNEEYFEFVQNRNNPKKKRKVSGGSSGGSPKKKRKVYPYDVPDYAYPYDVPDYAYPYDVPDYA

SEQ ID NO: 70 - protein, 16 aa, Artificial Sequence
  Synthetic
SGSETPGTSESATPES

SEQ ID NO: 71 - DNA, 23 bp, Zea mays
attgatagagcacatgagcttgg

SEQ ID NO: 72 - DNA, 23 bp, Zea mays
gtcacagatcacaaacttcaaat

SEQ ID NO: 73 - DNA, 23 bp, Glycine max
gaacccttgagagaggcttcttc

SEQ ID NO: 74 - DNA, 21 bp, Artificial Sequence
  crRNA
taatttctactaagtgtagat

SEQ ID NO: 75 - DNA, 20 bp, Artificial Sequence
  crRNA
taatttctactgttgtagat

SEQ ID NO: 76 - DNA, 5358 bp, Artificial Sequence
  Synthetic
atgtccgaggtggagttcagccacgagtactggatgaggcacgctctcaccctggctaagagggcgtgggacgagagggaggtgccggtgggcgccgtgctcgtccacaacaaccgcgtgatcggcgagggctggaacaggcccatcggcaggcacgacccaaccgctcacgccgagatcatggctctcaggcagggcggcctggtcatgcagaactacaggctgatcgacgcgaccctctacgtgaccctcgagccctgcgtcatgtgcgcgggcgccatgatccactccaggatcggcagggtggtcttcggcgctagggacgccaagacgggcgctgcgggcagcctcatggacgtgctgcaccaccccggcatgaaccaccgcgtcgagatcaccgagggcatcctcgcggacgagtgcgctgcgctcctgtccgacttcttcaggatgcgcaggcaggagatcaaggcccagaagaaggcgcagtccagcaccgactccggcggctccagcggcggctccagcggcagcgagaccccgggcacgtccgagagcgcgacgcccgagagcagcggcggctccagcggcggctcctcggaggtcgagttcagccatgagtactggatgaggcatgccctgactctcgctaagagggcgcgggatgagcgcgaggtgccggtgggggccgtgctcgtcctgaacaaccgcgtgatcggggagggctggaaccgggctatcggcctccacgacccaacggcccatgccgagatcatggccctgaggcagggcggcctggtcatgcaaaactacaggctcatcgacgccaccctctacgtgaccttcgagccatgcgtgatgtgcgcgggggccatgatccactcgaggattgggagggtggtcttcggcgtgcgcaacgctaagacgggggccgccggcagcctcatggacgtcctgcactacccgggcatgaaccacagggtggagattaccgagggcatcctggccgatgagtgcgccgcgctcctgtgctacttcttccgcatgcccaggcaggtcttcaacgcgcagaagaaggcccagagctccactgattccggcggctccagcggcggctccagtggcagcgagactcctggcacgtccgagagcgccacgcccgagtctagcggcggctccagcggcggctccgacaagaagtacagcatcggcctggcaatcggcaccaacagcgtgggctgggccgtgatcaccgacgagtacaaggtgccgagcaagaagttcaaggtgctgggcaacaccgacaggcacagcatcaagaagaacctgatcggcgccctgctgttcgacagcggcgagaccgccgaggccaccaggctgaagaggaccgccaggaggaggtacaccaggaggaagaacaggatctgctacctgcaggagatcttcagcaacgagatggccaaggtggacgacagcttcttccacaggctggaggagagcttcctggtggaggaggacaagaagcacgagaggcacccgatcttcggcaacatcgtggacgaggtggcctaccacgagaagtacccgaccatctaccacctgaggaagaagctggtggacagcaccgacaaggccgacctgaggctgatctacctggccctggcccacatgatcaagttcaggggccacttcctgatcgagggcgacctgaacccggacaacagcgacgtggacaagctgttcatccagctggtgcagacctacaaccagctgttcgaggagaacccgatcaacgccagcggcgtggacgccaaggccatcctgagcgccaggctgagcaagagcaggaggctggagaacctgatcgcccagctgccgggcgagaagaagaacggcctgttcggcaacctgatcgccctgagcctgggcctgaccccgaacttcaagagcaacttcgacctggccgaggacgccaagctgcagctgagcaaggacacctacgacgacgacctggacaacctgctggcccagatcggcgaccagtacgccgacctgttcctggccgccaagaacctgagcgacgccatcctgctgagcgacatcctgagggtgaacaccgagatcaccaaggccccgctgagcgccagcatgatcaagaggtacgacgagcaccaccaggacctgaccctgctgaaggccctggtgaggcagcagctgccggagaagtacaaggagatcttcttcgaccagagcaagaacggctacgccggctacatcgacggcggcgccagccaggaggagttctacaagttcatcaagccgatcctggagaagatggacggcaccgaggagctgctggtgaagctgaacagggaggacctgctgaggaagcagaggaccttcgacaacggcagcatcccgcaccagatccacctgggcgagctgcacgccatcctgaggaggcaggaggacttctacccgttcctgaaggacaacagggagaagatcgagaagatcctgaccttccgcatcccgtactacgtgggcccgctggccaggggcaacagcaggttcgcctggatgaccaggaagagcgaggagaccatcaccccgtggaacttcgaggaggtggtggacaagggcgccagcgcccagagcttcatcgagaggatgaccaacttcgacaagaacctgccgaacgagaaggtgctgccgaagcacagcctgctgtacgagtacttcaccgtgtacaacgagctgaccaaggtgaagtacgtgaccgagggcatgaggaagccggccttcctgagcggcgagcagaagaaggccatcgtggacctgctgttcaagaccaacaggaaggtgaccgtgaagcagctgaaggaggactacttcaagaagatcgagtgcttcgacagcgtggagatcagcggcgtggaggacaggttcaacgccagcctgggcacctaccacgacctgctgaagatcatcaaggacaaggacttcctggacaacgaggagaacgaggacatcctggaggacatcgtgctgaccctgaccctgttcgaggacagggagatgatcgaggagaggctgaagacctacgcccacctgttcgacgacaaggtgatgaagcagctgaagaggaggaggtacaccggctggggcaggctgagcaggaagctgatcaacggcatcagggacaagcagagcggcaagaccatcctggacttcctgaagagcgacggcttcgccaacaggaacttcatgcagctgatccacgacgacagcctgaccttcaaggaggacatccagaaggcccaggtgagcggccagggcgacagcctgcacgagcacatcgccaacctggccggcagcccggccatcaagaagggcatcctgcagaccgtgaaggtggtggacgagctggtgaaggtgatgggcaggcacaagccggagaacatcgtgatcgagatggccagggagaaccagaccacccagaagggccagaagaacagcagggagaggatgaagaggatcgaggagggcatcaaggagctgggcagccagatcctgaaggagcacccggtggagaacacccagctgcagaacgagaagctgtacctgtactacctgcagaacggcagggacatgtacgtggaccaggagctggacatcaacaggctgagcgactacgacgtggaccacatcgtgccgcagagcttcctgaaggacgacagcatcgacaacaaggtgctgaccaggagcgacaagaacaggggcaagagcgacaacgtgccgagcgaggaggtggtgaagaagatgaaaaactactggaggcagctgctgaacgccaagctgatcacccagaggaagttcgacaacctgaccaaggccgagaggggcggcctgagcgagctggacaaggccggcttcattaaaaggcagctggtggagaccaggcagatcaccaagcacgtggcccagatcctggacagcaggatgaacaccaagtacgacgagaacgacaagctgatcagggaggtgaaggtgatcaccctgaagagcaagctggtgagcgacttcaggaaggacttccagttctacaaggtgagggagatcaataattaccaccacgcccacgacgcctacctgaacgccgtggtgggcaccgccctgattaaaaagtacccgaagctggagagcgagttcgtgtacggcgactacaaggtgtacgacgtgaggaagatgatcgccaagagcgagcaggagatcggcaaggccaccgccaagtacttcttctacagcaacatcatgaacttcttcaagaccgagatcaccctggccaacggcgagatcaggaagaggccgctgatcgagaccaacggcgagaccggcgagatcgtgtgggacaagggcagggacttcgccaccgtgaggaaggtgctgtccatgccgcaggtgaacatcgtgaagaagaccgaggtgcagaccggcggcttcagcaaggagagcatcctgccgaagaggaacagcgacaagctgatcgccaggaagaaggactgggatccgaagaagtacggcggcttcgacagcccgaccgtggcctacagcgtgctggtggtggccaaggtggagaagggcaagagcaagaagctgaagagcgtgaaggagctggtgggcatcaccatcatggagaggagcagcttcgagaagaacccagtggacttcctggaggccaagggctacaaggaggtgaagaaggacctgatcattaaactgccgaagtacagcctgttcgagctggagaacggcaggaagaggatgctggccagcgccggcgagctgcagaagggcaacgagctggccctgccgagcaagtacgtgaacttcctgtacctggccagccactacgagaagctgaagggcagcccggaggacaacgagcagaagcagctgttcgtggagcagcacaagcactacctggacgagatcatcgagcagatcagcgagttcagcaagagggtgatcctggccgacgccaacctggacaaggtgctgagcgcctacaacaagcacagggacaagccgatcagggagcaggccgagaacatcatccacctgttcaccctgaccaacctgggcgccccggccgccttcaagtacttcgacaccaccatcgacaggaagaggtacaccagcaccaaggaggtgctggacgccaccctgatccaccagagcatcaccggcctgtacgagaccaggatcgacctgagccagctgggcggcgacagcagcccgccgaagaagaagaggaaggtgagctggaaggacgccagcggctggagcaggatgtga

SEQ ID NO: 77 - protein, 1785 aa, Artificial Sequence
  Fusion protein
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELVGITIMERSSFEKNPVDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSSPPKKKRKVSWKDASGWSRM

SEQ ID NO: 78 - DNA, 5094 bp, Artificial Sequence
  Syntheic
atgtccgaggtggagttcagccacgagtactggatgaggcacgctctcaccctggctaagagggcgtgggacgagagggaggtgccggtgggcgccgtgctcgtccacaacaaccgcgtgatcggcgagggctggaacaggcccatcggcaggcacgacccaaccgctcacgccgagatcatggctctcaggcagggcggcctggtcatgcagaactacaggctgatcgacgcgaccctctacgtgaccctcgagccctgcgtcatggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaatttgttgatgtgcagtgcgcgggcgccatgatccactccaggatcggcagggtggtcttcggcgctagggacgccaagacgggcgctgcgggcagcctcatggacgtgctgcaccaccccggcatgaaccaccgcgtcgagatcaccgagggcatcctcgcggacgagtgcgctgcgctcctgtccgacttcttcaggatgcgcaggcaggagatcaaggcccagaagaaggcgcagtccagcaccgactccggcggctccagcggcggctccagcggcagcgagaccccgggcacgtccgagagcgcgacgcccgagagcagcggcggctccagcggcggctcctcggaggtcgagttcagccatgagtactggatgaggcatgccctgactctcgctaagagggcgcgggatgagcgcgaggtgccggtgggggccgtgctcgtcctgaacaaccgcgtgatcggggagggctggaaccgggctatcggcctccacgacccaacggcccatgccgagatcatggccctgaggcagggcggcctggtcatgcaaaactacaggctcatcgacgccaccctctacgtgaccttcgagccatgcgtgatgtgcgcgggggccatgatccactcgaggattgggagggtggtcttcggcgtgcgcaacgctaagacgggggccgccggcagcctcatggacgtcctgcactacccgggcatgaaccacagggtggagattaccgagggcatcctggccgatgagtgcgccgcgctcctgtgctacttcttccgcatgcccaggcaggtcttcaacgcgcagaagaaggcccagagctccactgattccggcggctccagcggcggctccagtggcagcgagactcctggcacgtccgagagcgccacgcccgagtctagcggcggctccagcggcggctccatgagcaagctggagaagttcacgaactgctactccctcagcaagaccctgaggttcaaggcgatcccggtcggcaagacccaggagaacatcgacaacaagcggctgctggtggaggacgagaagagggctgaggactacaagggcgtgaagaagctcctggaccgctactacctgtccttcatcaacgacgtgctccacagcatcaagctcaagaacctgaacaactacatcagcctcttcaggaagaagacgcgcaccgagaaggagaacaaggagctcgagaacctggagatcaacctgaggaaggagatcgccaaggcgttcaagggcaacgagggctacaagtccctcttcaagaaggacatcatcgagacgatcctcccggagttcctggacgacaaggacgagatcgccctggtcaactccttcaacggcttcaccacggcgttcaccggcttcttcgacaaccgcgagaacatgttcagcgaggaggccaagtccacgagcatcgcgttcaggtgcatcaacgagaacctcacccgctacatctccaacatggacatcttcgagaaggtcgacgcgatcttcgacaagcacgaggtgcaggagatcaaggagaagatcctgaacagcgactacgacgtcgaggacttcttcgagggcgagttcttcaacttcgtcctcacgcaggagggcatcgacgtgtacaacgccatcatcggtggcttcgtgaccgagtccggcgagaagatcaagggcctgaacgagtacatcaacctctacaaccagaagaccaagcagaagctgccgaagttcaagcccctgtacaagcaggtgctctccgacagggagtccctcagcttctacggcgagggctacacgagcgacgaggaggtcctggaggtgttccgcaacaccctcaacaagaacagcgagatcttctccagcatcaagaagctcgagaagctgttcaagaacttcgacgagtactccagcgccggcatcttcgtcaagaacggcccggcgatctccacgatcagcaaggacatcttcggcgagtggaacgtgatccgcgacaagtggaacgccgagtacgacgacatccacctcaagaagaaggcggtggtcaccgagaagtacgaggacgacaggcgcaagtccttcaagaagatcggctccttcagcctcgagcagctgcaggagtacgccgacgcggacctgagcgtggtcgagaagctcaaggagatcatcatccagaaggtcgacgagatctacaaggtgtacggctccagcgagaagctcttcgacgcggacttcgtcctcgagaagtccctgaagaagaacgacgccgtggtcgcgatcatgaaggacctcctggactccgtgaagagcttcgagaattacatcaaggccttcttcggcgagggcaaggagacgaacagggacgagtccttctacggcgacttcgtcctggcctacgacatcctcctgaaggtggaccacatctacgacgcgatccgcaactacgtgacccagaagccgtacagcaaggacaagttcaagctctacttccagaacccccagttcatgggcggctgggacaaggacaaggagacggactacagggcgaccatcctgcgctacggcagcaagtactacctcgccatcatggacaagaagtacgcgaagtgcctgcagaagatcgacaaggacgacgtcaacggcaactacgagaagatcaactacaagctcctgccgggccccaacaagatgctcccgaaggtgttcttctccaagaagtggatggcctactacaaccccagcgaggacatccagaagatctacaagaacggcacgttcaagaagggcgacatgttcaacctgaacgactgccacaagctcatcgacttcttcaaggactccatcagccgctacccgaagtggtccaacgcctacgacttcaacttcagcgagaccgagaagtacaaggacatcgcgggcttctaccgcgaggtcgaggagcagggctacaaggtgtccttcgagtccgccagcaagaaggaggtcgacaagctggtggaggagggcaagctctacatgttccagatctacaacaaggacttctccgacaagagccacggcacgcccaacctgcacaccatgtacttcaagctcctgttcgacgagaacaaccacggccagatcaggctgtccggcggcgccgagctcttcatgaggagggcgagcctgaagaaggaggagctggtggtccaccccgctaacagcccaatcgcgaacaagaacccggacaaccccaagaagaccacgaccctgtcctacgacgtgtacaaggacaagaggttcagcgaggaccagtacgagctccacatcccgatcgcgatcaacaagtgccccaagaacatcttcaagatcaacaccgaggtccgcgtgctcctgaagcacgacgacaacccctacgtgatcggcatcgctaggggcgagaggaacctcctgtacatcgtggtcgtggacggcaagggcaacatcgtggagcagtactccctcaacgagatcatcaacaacttcaacggcatcaggatcaagacggactaccacagcctcctggacaagaaggagaaggagaggttcgaggcccgccagaactggacctccatcgagaacatcaaggagctgaaggcgggctacatcagccaggtcgtgcacaagatctgcgagctcgtcgagaagtacgacgccgtgatcgccctcgcggacctgaactccggcttcaagaacagccgcgtcaaggtggagaagcaggtctaccagaagttcgagaagatgctcatcgacaagctgaactacatggtggacaagaagtccaacccctgcgctacgggcggcgcgctgaagggctaccagatcaccaacaagttcgagagcttcaagtccatgagcactcagaacggcttcatcttctacatcccggcgtggctcacgtccaagatcgaccccagcaccggcttcgtcaacctcctgaagacgaagtacacctccatcgccgacagcaagaagttcatctccagcttcgaccgcatcatgtatgtgccggaggaggacctgttcgagttcgccctcgactacaagaacttctcccgcacggacgcggactacatcaagaagtggaagctgtacagctacggcaaccgcatccgcatcttcaggaaccccaagaagaacaacgtcttcgactgggaggaggtgtgcctgacctccgcgtacaaggagctcttcaacaagtacggcatcaactaccagcagggcgacatcagggctctcctgtgcgagcagagcgacaaggccttctactccagcttcatggcgctgatgtccctcatgctgcagatgaggaactcgatcaccggcaggacggacgtggccttcctcatctccccggtgaagaacagcgacggcatcttctacgactccaggaactacgaggcccaggagaacgcgatcctcccaaagaacgcggacgccaacggcgcctacaacatcgccaggaaggtcctctgggctatcggccagttcaagaaggcggaggacgagaagctggacaaggtgaagatcgccatcagcaacaaggagtggctcgagtacgcccagacctcggtcaagcacggcagcccgaagaagaagcgcaaggtgtga

SEQ ID NO: 79 - protein, 1691 aa, Artificial Sequence
  Fusion protein
MSEVEFSHEYWMRHALTLAKRAWDEREVPVGAVLVHNNRVIGEGWNRPIGRHDPTAHAEIMALRQGGLVMQNYRLIDATLYVTLEPCVMVSFCFYLYIYNNYHLVVIYFKYFFQNKRMYIAIAFLFISVYILIYNFSNIPKFVDVQCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDSGGSSGGSSGSETPGTSESATPESSGGSSGGSMSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIARGERNLLYIVVVDGKGNIVEQYSLNEIINNFNGIRIKTDYHSLLDKKEKERFEARQNWTSIENIKELKAGYISQVVHKICELVEKYDAVIALADLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVAFLISPVKNSDGIFYDSRNYEAQENAILPKNADANGAYNIARKVLWAIGQFKKAEDEKLDKVKIAISNKEWLEYAQTSVKHGSPKKKRKV

SEQ ID NO: 80 - DNA, 5088 bp, Artificial Sequence
  Synthetic
atgtccgaggtggagttcagccacgagtactggatgaggcacgctctcaccctggctaagagggcgtgggacgagagggaggtgccggtgggcgccgtgctcgtccacaacaaccgcgtgatcggcgagggctggaacaggcccatcggcaggcacgacccaaccgctcacgccgagatcatggctctcaggcagggcggcctggtcatgcagaactacaggctgatcgacgcgaccctctacgtgaccctcgagccctgcgtcatggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaatttgttgatgtgcagtgcgcgggcgccatgatccactccaggatcggcagggtggtcttcggcgctagggacgccaagacgggcgctgcgggcagcctcatggacgtgctgcaccaccccggcatgaaccaccgcgtcgagatcaccgagggcatcctcgcggacgagtgcgctgcgctcctgtccgacttcttcaggatgcgcaggcaggagatcaaggcccagaagaaggcgcagtccagcaccgactccggcggctccagcggcggctccagcggcagcgagaccccgggcacgtccgagagcgcgacgcccgagagcagcggcggctccagcggcggctcctcggaggtcgagttcagccatgagtactggatgaggcatgccctgactctcgctaagagggcgcgggatgagcgcgaggtgccggtgggggccgtgctcgtcctgaacaaccgcgtgatcggggagggctggaaccgggctatcggcctccacgacccaacggcccatgccgagatcatggccctgaggcagggcggcctggtcatgcaaaactacaggctcatcgacgccaccctctacgtgaccttcgagccatgcgtgatgtgcgcgggggccatgatccactcgaggattgggagggtggtcttcggcgtgcgcaacgctaagacgggggccgccggcagcctcatggacgtcctgcactacccgggcatgaaccacagggtggagattaccgagggcatcctggccgatgagtgcgccgcgctcctgtgctacttcttccgcatgcccaggcaggtcttcaacgcgcagaagaaggcccagagctccactgatgggggcgggggctcaggcgggggcgggagcggcggcgggggctctgggggcggcggcagcggcgggggcggcagcgggggcggcgggtcgatgagcaagctggagaagttcacgaactgctactccctcagcaagaccctgaggttcaaggcgatcccggtcggcaagacccaggagaacatcgacaacaagcggctgctggtggaggacgagaagagggctgaggactacaagggcgtgaagaagctcctggaccgctactacctgtccttcatcaacgacgtgctccacagcatcaagctcaagaacctgaacaactacatcagcctcttcaggaagaagacgcgcaccgagaaggagaacaaggagctcgagaacctggagatcaacctgaggaaggagatcgccaaggcgttcaagggcaacgagggctacaagtccctcttcaagaaggacatcatcgagacgatcctcccggagttcctggacgacaaggacgagatcgccctggtcaactccttcaacggcttcaccacggcgttcaccggcttcttcgacaaccgcgagaacatgttcagcgaggaggccaagtccacgagcatcgcgttcaggtgcatcaacgagaacctcacccgctacatctccaacatggacatcttcgagaaggtcgacgcgatcttcgacaagcacgaggtgcaggagatcaaggagaagatcctgaacagcgactacgacgtcgaggacttcttcgagggcgagttcttcaacttcgtcctcacgcaggagggcatcgacgtgtacaacgccatcatcggtggcttcgtgaccgagtccggcgagaagatcaagggcctgaacgagtacatcaacctctacaaccagaagaccaagcagaagctgccgaagttcaagcccctgtacaagcaggtgctctccgacagggagtccctcagcttctacggcgagggctacacgagcgacgaggaggtcctggaggtgttccgcaacaccctcaacaagaacagcgagatcttctccagcatcaagaagctcgagaagctgttcaagaacttcgacgagtactccagcgccggcatcttcgtcaagaacggcccggcgatctccacgatcagcaaggacatcttcggcgagtggaacgtgatccgcgacaagtggaacgccgagtacgacgacatccacctcaagaagaaggcggtggtcaccgagaagtacgaggacgacaggcgcaagtccttcaagaagatcggctccttcagcctcgagcagctgcaggagtacgccgacgcggacctgagcgtggtcgagaagctcaaggagatcatcatccagaaggtcgacgagatctacaaggtgtacggctccagcgagaagctcttcgacgcggacttcgtcctcgagaagtccctgaagaagaacgacgccgtggtcgcgatcatgaaggacctcctggactccgtgaagagcttcgagaattacatcaaggccttcttcggcgagggcaaggagacgaacagggacgagtccttctacggcgacttcgtcctggcctacgacatcctcctgaaggtggaccacatctacgacgcgatccgcaactacgtgacccagaagccgtacagcaaggacaagttcaagctctacttccagaacccccagttcatgggcggctgggacaaggacaaggagacggactacagggcgaccatcctgcgctacggcagcaagtactacctcgccatcatggacaagaagtacgcgaagtgcctgcagaagatcgacaaggacgacgtcaacggcaactacgagaagatcaactacaagctcctgccgggccccaacaagatgctcccgaaggtgttcttctccaagaagtggatggcctactacaaccccagcgaggacatccagaagatctacaagaacggcacgttcaagaagggcgacatgttcaacctgaacgactgccacaagctcatcgacttcttcaaggactccatcagccgctacccgaagtggtccaacgcctacgacttcaacttcagcgagaccgagaagtacaaggacatcgcgggcttctaccgcgaggtcgaggagcagggctacaaggtgtccttcgagtccgccagcaagaaggaggtcgacaagctggtggaggagggcaagctctacatgttccagatctacaacaaggacttctccgacaagagccacggcacgcccaacctgcacaccatgtacttcaagctcctgttcgacgagaacaaccacggccagatcaggctgtccggcggcgccgagctcttcatgaggagggcgagcctgaagaaggaggagctggtggtccaccccgctaacagcccaatcgcgaacaagaacccggacaaccccaagaagaccacgaccctgtcctacgacgtgtacaaggacaagaggttcagcgaggaccagtacgagctccacatcccgatcgcgatcaacaagtgccccaagaacatcttcaagatcaacaccgaggtccgcgtgctcctgaagcacgacgacaacccctacgtgatcggcatcgctaggggcgagaggaacctcctgtacatcgtggtcgtggacggcaagggcaacatcgtggagcagtactccctcaacgagatcatcaacaacttcaacggcatcaggatcaagacggactaccacagcctcctggacaagaaggagaaggagaggttcgaggcccgccagaactggacctccatcgagaacatcaaggagctgaaggcgggctacatcagccaggtcgtgcacaagatctgcgagctcgtcgagaagtacgacgccgtgatcgccctcgcggacctgaactccggcttcaagaacagccgcgtcaaggtggagaagcaggtctaccagaagttcgagaagatgctcatcgacaagctgaactacatggtggacaagaagtccaacccctgcgctacgggcggcgcgctgaagggctaccagatcaccaacaagttcgagagcttcaagtccatgagcactcagaacggcttcatcttctacatcccggcgtggctcacgtccaagatcgaccccagcaccggcttcgtcaacctcctgaagacgaagtacacctccatcgccgacagcaagaagttcatctccagcttcgaccgcatcatgtatgtgccggaggaggacctgttcgagttcgccctcgactacaagaacttctcccgcacggacgcggactacatcaagaagtggaagctgtacagctacggcaaccgcatccgcatcttcaggaaccccaagaagaacaacgtcttcgactgggaggaggtgtgcctgacctccgcgtacaaggagctcttcaacaagtacggcatcaactaccagcagggcgacatcagggctctcctgtgcgagcagagcgacaaggccttctactccagcttcatggcgctgatgtccctcatgctgcagatgaggaactcgatcaccggcaggacggacgtggccttcctcatctccccggtgaagaacagcgacggcatcttctacgactccaggaactacgaggcccaggagaacgcgatcctcccaaagaacgcggacgccaacggcgcctacaacatcgccaggaaggtcctctgggctatcggccagttcaagaaggcggaggacgagaagctggacaaggtgaagatcgccatcagcaacaaggagtggctcgagtacgcccagacctcggtcaagcacggcagcccgaagaagaagcgcaaggtgtga

SEQ ID NO: 81 - protein, 1689 aa, Artificial Sequence
  Fusion protein
MSEVEFSHEYWMRHALTLAKRAWDEREVPVGAVLVHNNRVIGEGWNRPIGRHDPTAHAEIMALRQGGLVMQNYRLIDATLYVTLEPCVMVSFCFYLYIYNNYHLVVIYFKYFFQNKRMYIAIAFLFISVYILIYNFSNIPKFVDVQCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDGGGGSGGGGSGGGGSGGGGSGGGGSGGGGSMSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIARGERNLLYIVVVDGKGNIVEQYSLNEIINNFNGIRIKTDYHSLLDKKEKERFEARQNWTSIENIKELKAGYISQVVHKICELVEKYDAVIALADLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVAFLISPVKNSDGIFYDSRNYEAQENAILPKNADANGAYNIARKVLWAIGQFKKAEDEKLDKVKIAISNKEWLEYAQTSVKHGSPKKKRKV

SEQ ID NO: 82 - DNA, 4936 bp, Artificial Sequence
  Synthetic
atgccgaagaagaagcgcaaggtcatgaccgacgcggagtatgtgcgcatccacgagaagctcgacatctacaccttcaagaagcagttcttcaacaacaagaagagcgtctcccacaggtgctacgtgctcttcgagctgaagaggcgcggcgagcgcagggcctgcttctggggctacgccgtgaacaagccgcagagcggcaccgagcgcggcatccacgccgagatcttcagcatccgcaaggtggaggagtacctcagggacaacccgggccagttcaccatcaactggtacagctcctggagcccggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaatttgttgatgtgcagtgcgcggactgcgccgagaagatcctggagtggtacaaccaggagctgaggggcaacggccacaccctgaagatctgggcctgcaagctctactacgagaagaacgcgaggaaccagatcggcctgtggaacctccgcgacaacggcgtcggcctcaacgtgatggtctccgagcactaccagtgctgccgcaagatcttcatccagtccagccacaaccagctcaacgagaacaggtggctggagaagaccctgaagagggccgagaagcgcaggtccgagctcagcatcatgatccaggtgaagatcctccacaccacgaagtcccccgccgtgggggggcgggggctcaggcgggggcgggagcggcggcgggggctctgggggcggcggcagcggcgggggcggcagcgggggcggcgggtcgatgagcaagctggagaagttcacgaactgctactccctcagcaagaccctgaggttcaaggcgatcccggtcggcaagacccaggagaacatcgacaacaagcggctgctggtggaggacgagaagagggctgaggactacaagggcgtgaagaagctcctggaccgctactacctgtccttcatcaacgacgtgctccacagcatcaagctcaagaacctgaacaactacatcagcctcttcaggaagaagacgcgcaccgagaaggagaacaaggagctcgagaacctggagatcaacctgaggaaggagatcgccaaggcgttcaagggcaacgagggctacaagtccctcttcaagaaggacatcatcgagacgatcctcccggagttcctggacgacaaggacgagatcgccctggtcaactccttcaacggcttcaccacggcgttcaccggcttcttcgacaaccgcgagaacatgttcagcgaggaggccaagtccacgagcatcgcgttcaggtgcatcaacgagaacctcacccgctacatctccaacatggacatcttcgagaaggtcgacgcgatcttcgacaagcacgaggtgcaggagatcaaggagaagatcctgaacagcgactacgacgtcgaggacttcttcgagggcgagttcttcaacttcgtcctcacgcaggagggcatcgacgtgtacaacgccatcatcggtggcttcgtgaccgagtccggcgagaagatcaagggcctgaacgagtacatcaacctctacaaccagaagaccaagcagaagctgccgaagttcaagcccctgtacaagcaggtgctctccgacagggagtccctcagcttctacggcgagggctacacgagcgacgaggaggtcctggaggtgttccgcaacaccctcaacaagaacagcgagatcttctccagcatcaagaagctcgagaagctgttcaagaacttcgacgagtactccagcgccggcatcttcgtcaagaacggcccggcgatctccacgatcagcaaggacatcttcggcgagtggaacgtgatccgcgacaagtggaacgccgagtacgacgacatccacctcaagaagaaggcggtggtcaccgagaagtacgaggacgacaggcgcaagtccttcaagaagatcggctccttcagcctcgagcagctgcaggagtacgccgacgcggacctgagcgtggtcgagaagctcaaggagatcatcatccagaaggtcgacgagatctacaaggtgtacggctccagcgagaagctcttcgacgcggacttcgtcctcgagaagtccctgaagaagaacgacgccgtggtcgcgatcatgaaggacctcctggactccgtgaagagcttcgagaattacatcaaggccttcttcggcgagggcaaggagacgaacagggacgagtccttctacggcgacttcgtcctggcctacgacatcctcctgaaggtggaccacatctacgacgcgatccgcaactacgtgacccagaagccgtacagcaaggacaagttcaagctctacttccagaacccccagttcatgggcggctgggacaaggacaaggagacggactacagggcgaccatcctgcgctacggcagcaagtactacctcgccatcatggacaagaagtacgcgaagtgcctgcagaagatcgacaaggacgacgtcaacggcaactacgagaagatcaactacaagctcctgccgggccccaacaagatgctcccgaaggtgttcttctccaagaagtggatggcctactacaaccccagcgaggacatccagaagatctacaagaacggcacgttcaagaagggcgacatgttcaacctgaacgactgccacaagctcatcgacttcttcaaggactccatcagccgctacccgaagtggtccaacgcctacgacttcaacttcagcgagaccgagaagtacaaggacatcgcgggcttctaccgcgaggtcgaggagcagggctacaaggtgtccttcgagtccgccagcaagaaggaggtcgacaagctggtggaggagggcaagctctacatgttccagatctacaacaaggacttctccgacaagagccacggcacgcccaacctgcacaccatgtacttcaagctcctgttcgacgagaacaaccacggccagatcaggctgtccggcggcgccgagctcttcatgaggagggcgagcctgaagaaggaggagctggtggtccaccccgctaacagcccaatcgcgaacaagaacccggacaaccccaagaagaccacgaccctgtcctacgacgtgtacaaggacaagaggttcagcgaggaccagtacgagctccacatcccgatcgcgatcaacaagtgccccaagaacatcttcaagatcaacaccgaggtccgcgtgctcctgaagcacgacgacaacccctacgtgatcggcatcgctaggggcgagaggaacctcctgtacatcgtggtcgtggacggcaagggcaacatcgtggagcagtactccctcaacgagatcatcaacaacttcaacggcatcaggatcaagacggactaccacagcctcctggacaagaaggagaaggagaggttcgaggcccgccagaactggacctccatcgagaacatcaaggagctgaaggcgggctacatcagccaggtcgtgcacaagatctgcgagctcgtcgagaagtacgacgccgtgatcgccctcgcggacctgaactccggcttcaagaacagccgcgtcaaggtggagaagcaggtctaccagaagttcgagaagatgctcatcgacaagctgaactacatggtggacaagaagtccaacccctgcgctacgggcggcgcgctgaagggctaccagatcaccaacaagttcgagagcttcaagtccatgagcactcagaacggcttcatcttctacatcccggcgtggctcacgtccaagatcgaccccagcaccggcttcgtcaacctcctgaagacgaagtacacctccatcgccgacagcaagaagttcatctccagcttcgaccgcatcatgtatgtgccggaggaggacctgttcgagttcgccctcgactacaagaacttctcccgcacggacgcggactacatcaagaagtggaagctgtacagctacggcaaccgcatccgcatcttcaggaaccccaagaagaacaacgtcttcgactgggaggaggtgtgcctgacctccgcgtacaaggagctcttcaacaagtacggcatcaactaccagcagggcgacatcagggctctcctgtgcgagcagagcgacaaggccttctactccagcttcatggcgctgatgtccctcatgctgcagatgaggaactcgatcaccggcaggacggacgtggccttcctcatctccccggtgaagaacagcgacggcatcttctacgactccaggaactacgaggcccaggagaacgcgatcctcccaaagaacgcggacgccaacggcgcctacaacatcgccaggaaggtcctctgggctatcggccagttcaagaaggcggaggacgagaagctggacaaggtgaagatcgccatcagcaacaaggagtggctcgagtacgcccagacctcggtcaagcacggcagcccgaagaagaagcgcaaggtgtccggcggcagcacgaacctgtccgacatcatcgagaaggagaccggcaagcagctcgtgatccaggagagcatcctcatgctgccggaggaggtcgaggaggtcatcggcaacaagcccgagtccgacatcctcgtccacacggcctacgacgagtccaccgacgagaacgtgatgctcctgacctcggacgctcccgagtacaagccatgggccctggtcatccaggacagcaacggcgagaacaagatcaagatgctctccggcggcagcccgaagaagaagcgcaaagtgtga

SEQ ID NO: 83 - protein, 1636 aa, Artificial Sequence
  Fusion protein
MPKKKRKVMTDAEYVRIHEKLDIYTFKKQFFNNKKSVSHRCYVLFELKRRGERRACFWGYAVNKPQSGTERGIHAEIFSIRKVEEYLRDNPGQFTINWYSSWSPVSFCFYLYIYNNYHLVVIYFKYFFQNKRMYIAIAFLFISVYILIYNFSNIPKFVDVQCADCAEKILEWYNQELRGNGHTLKIWACKLYYEKNARNQIGLWNLRDNGVGLNVMVSEHYQCCRKIFIQSSHNQLNENRWLEKTLKRAEKRRSELSIMIQVKILHTTKSPAVGGRGLRRGRERRRGLWGRRQRRGRQRGRRVDEQAGEVHELLLPQQDPEVQGDPGRQDPGEHRQQAAAGGGREEGGLQGREEAPGPLLPVLHQRRAPQHQAQEPEQLHQPLQEEDAHREGEQGAREPGDQPEEGDRQGVQGQRGLQVPLQEGHHRDDPPGVPGRQGRDRPGQLLQRLHHGVHRLLRQPREHVQRGGQVHEHRVQVHQREPHPLHLQHGHLREGRRDLRQARGAGDQGEDPEQRLRRRGLLRGRVLQLRPHAGGHRRVQRHHRWLRDRVRREDQGPERVHQPLQPEDQAEAAEVQAPVQAGALRQGVPQLLRRGLHERRGGPGGVPQHPQQEQRDLLQHQEAREAVQELRRVLQRRHLRQERPGDLHDQQGHLRRVERDPRQVERRVRRHPPQEEGGGHREVRGRQAQVLQEDRLLQPRAAAGVRRRGPERGREAQGDHHPEGRRDLQGVRLQREALRRGLRPREVPEEERRRGRDHEGPPGLREELRELHQGLLRRGQGDEQGRVLLRRLRPGLRHPPEGGPHLRRDPQLRDPEAVQQGQVQALLPEPPVHGRLGQGQGDGLQGDHPALRQQVLPRHHGQEVREVPAEDRQGRRQRQLREDQLQAPAGPQQDAPEGVLLQEVDGLLQPQRGHPEDLQERHVQEGRHVQPERLPQAHRLLQGLHQPLPEVVQRLRLQLQRDREVQGHRGLLPRGRGAGLQGVLRVRQQEGGRQAGGGGQALHVPDLQQGLLRQEPRHAQPAHHVLQAPVRREQPRPDQAVRRRRALHEEGEPEEGGAGGPPRQPNREQEPGQPQEDHDPVLRRVQGQEVQRGPVRAPHPDRDQQVPQEHLQDQHRGPRAPEARRQPLRDRHRGREEPPVHRGRGRQGQHRGAVLPQRDHQQLQRHQDQDGLPQPPGQEGEGEVRGPPELDLHREHQGAEGGLHQPGRAQDLRARREVRRRDRPRGPELRLQEQPRQGGEAGLPEVREDAHRQAELHGGQEVQPLRYGRRAEGLPDHQQVRELQVHEHSERLHLLHPGVAHVQDRPQHRLRQPPEDEVHLHRRQQEVHLQLRPHHVCAGGGPVRVRPRLQELLPHGRGLHQEVEAVQLRQPHPHLQEPQEEQRLRLGGGVPDLRVQGALQQVRHQLPAGRHQGSPVRAERQGLLLQLHGADVPHAADEELDHRQDGRGLPHLPGEEQRRHLLRLQELRGPGERDPPKERGRQRRLQHRQEGPLGYRPVQEGGGREAGQGEDRHQQQGVARVRPDLGQARQPEEEAQGVRRQHEPVRHHREGDRQAARDPGEHPHAAGGGRGGHRQQARVRHPRPHGLRRVHRRERDAPDLGRSRVQAMGPGHPGQQRREQDQDALRRQPEEEAQSV

SEQ ID NO: 84 - DNA, 6210 bp, Artificial Sequence
  Synthetic
atgtccgaggtggagttcagccacgagtactggatgaggcacgctctcaccctggctaagagggcgtgggacgagagggaggtgccggtgggcgccgtgctcgtccacaacaaccgcgtgatcggcgagggctggaacaggcccatcggcaggcacgacccaaccgctcacgccgagatcatggctctcaggcagggcggcctggtcatgcagaactacaggctgatcgacgcgaccctctacgtgaccctcgagccctgcgtcatggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaatttgttgatgtgcagtgcgcgggcgccatgatccactccaggatcggcagggtggtcttcggcgctagggacgccaagacgggcgctgcgggcagcctcatggacgtgctgcaccaccccggcatgaaccaccgcgtcgagatcaccgagggcatcctcgcggacgagtgcgctgcgctcctgtccgacttcttcaggatgcgcaggcaggagatcaaggcccagaagaaggcgcagtccagcaccgactccggcggctccagcggcggctccagcggcagcgagaccccgggcacgtccgagagcgcgacgcccgagagcagcggcggctccagcggcggctcctcggaggtcgagttcagccatgagtactggatgaggcatgccctgactctcgctaagagggcgcgggatgagcgcgaggtgccggtgggggccgtgctcgtcctgaacaaccgcgtgatcggggagggctggaaccgggctatcggcctccacgacccaacggcccatgccgagatcatggccctgaggcagggcggcctggtcatgcaaaactacaggctcatcgacgccaccctctacgtgaccttcgagccatgcgtgatgtgcgcgggggccatgatccactcgaggattgggagggtggtcttcggcgtgcgcaacgctaagacgggggccgccggcagcctcatggacgtcctgcactacccgggcatgaaccacagggtggagattaccgagggcatcctggccgatgagtgcgccgcgctcctgtgctacttcttccgcatgcccaggcaggtcttcaacgcgcagaagaaggcccagagctccactgatgggggcgggggctcaggcgggggcgggagcggcggcgggggctctgggggcggcggcagcggcgggggcggcagcgggggcggcgggtcgatgagcaagctggagaagttcacgaactgctactccctcagcaagaccctgaggttcaaggcgatcccggtcggcaagacccaggagaacatcgacaacaagcggctgctggtggaggacgagaagagggctgaggactacaagggcgtgaagaagctcctggaccgctactacctgtccttcatcaacgacgtgctccacagcatcaagctcaagaacctgaacaactacatcagcctcttcaggaagaagacgcgcaccgagaaggagaacaaggagctcgagaacctggagatcaacctgaggaaggagatcgccaaggcgttcaagggcaacgagggctacaagtccctcttcaagaaggacatcatcgagacgatcctcccggagttcctggacgacaaggacgagatcgccctggtcaactccttcaacggcttcaccacggcgttcaccggcttcttcgacaaccgcgagaacatgttcagcgaggaggccaagtccacgagcatcgcgttcaggtgcatcaacgagaacctcacccgctacatctccaacatggacatcttcgagaaggtcgacgcgatcttcgacaagcacgaggtgcaggagatcaaggagaagatcctgaacagcgactacgacgtcgaggacttcttcgagggcgagttcttcaacttcgtcctcacgcaggagggcatcgacgtgtacaacgccatcatcggtggcttcgtgaccgagtccggcgagaagatcaagggcctgaacgagtacatcaacctctacaaccagaagaccaagcagaagctgccgaagttcaagcccctgtacaagcaggtgctctccgacagggagtccctcagcttctacggcgagggctacacgagcgacgaggaggtcctggaggtgttccgcaacaccctcaacaagaacagcgagatcttctccagcatcaagaagctcgagaagctgttcaagaacttcgacgagtactccagcgccggcatcttcgtcaagaacggcccggcgatctccacgatcagcaaggacatcttcggcgagtggaacgtgatccgcgacaagtggaacgccgagtacgacgacatccacctcaagaagaaggcggtggtcaccgagaagtacgaggacgacaggcgcaagtccttcaagaagatcggctccttcagcctcgagcagctgcaggagtacgccgacgcggacctgagcgtggtcgagaagctcaaggagatcatcatccagaaggtcgacgagatctacaaggtgtacggctccagcgagaagctcttcgacgcggacttcgtcctcgagaagtccctgaagaagaacgacgccgtggtcgcgatcatgaaggacctcctggactccgtgaagagcttcgagaattacatcaaggccttcttcggcgagggcaaggagacgaacagggacgagtccttctacggcgacttcgtcctggcctacgacatcctcctgaaggtggaccacatctacgacgcgatccgcaactacgtgacccagaagccgtacagcaaggacaagttcaagctctacttccagaacccccagttcatgggcggctgggacaaggacaaggagacggactacagggcgaccatcctgcgctacggcagcaagtactacctcgccatcatggacaagaagtacgcgaagtgcctgcagaagatcgacaaggacgacgtcaacggcaactacgagaagatcaactacaagctcctgccgggccccaacaagatgctcccgaaggtgttcttctccaagaagtggatggcctactacaaccccagcgaggacatccagaagatctacaagaacggcacgttcaagaagggcgacatgttcaacctgaacgactgccacaagctcatcgacttcttcaaggactccatcagccgctacccgaagtggtccaacgcctacgacttcaacttcagcgagaccgagaagtacaaggacatcgcgggcttctaccgcgaggtcgaggagcagggctacaaggtgtccttcgagtccgccagcaagaaggaggtcgacaagctggtggaggagggcaagctctacatgttccagatctacaacaaggacttctccgacaagagccacggcacgcccaacctgcacaccatgtacttcaagctcctgttcgacgagaacaaccacggccagatcaggctgtccggcggcgccgagctcttcatgaggagggcgagcctgaagaaggaggagctggtggtccaccccgctaacagcccaatcgcgaacaagaacccggacaaccccaagaagaccacgaccctgtcctacgacgtgtacaaggacaagaggttcagcgaggaccagtacgagctccacatcccgatcgcgatcaacaagtgccccaagaacatcttcaagatcaacaccgaggtccgcgtgctcctgaagcacgacgacaacccctacgtgatcggcatcgctaggggcgagaggaacctcctgtacatcgtggtcgtggacggcaagggcaacatcgtggagcagtactccctcaacgagatcatcaacaacttcaacggcatcaggatcaagacggactaccacagcctcctggacaagaaggagaaggagaggttcgaggcccgccagaactggacctccatcgagaacatcaaggagctgaaggcgggctacatcagccaggtcgtgcacaagatctgcgagctcgtcgagaagtacgacgccgtgatcgccctcgcggacctgaactccggcttcaagaacagccgcgtcaaggtggagaagcaggtctaccagaagttcgagaagatgctcatcgacaagctgaactacatggtggacaagaagtccaacccctgcgctacgggcggcgcgctgaagggctaccagatcaccaacaagttcgagagcttcaagtccatgagcactcagaacggcttcatcttctacatcccggcgtggctcacgtccaagatcgaccccagcaccggcttcgtcaacctcctgaagacgaagtacacctccatcgccgacagcaagaagttcatctccagcttcgaccgcatcatgtatgtgccggaggaggacctgttcgagttcgccctcgactacaagaacttctcccgcacggacgcggactacatcaagaagtggaagctgtacagctacggcaaccgcatccgcatcttcaggaaccccaagaagaacaacgtcttcgactgggaggaggtgtgcctgacctccgcgtacaaggagctcttcaacaagtacggcatcaactaccagcagggcgacatcagggctctcctgtgcgagcagagcgacaaggccttctactccagcttcatggcgctgatgtccctcatgctgcagatgaggaactcgatcaccggcaggacggacgtggccttcctcatctccccggtgaagaacagcgacggcatcttctacgactccaggaactacgaggcccaggagaacgcgatcctcccaaagaacgcggacgccaacggcgcctacaacatcgccaggaaggtcctctgggctatcggccagttcaagaaggcggaggacgagaagctggacaaggtgaagatcgccatcagcaacaaggagtggctcgagtacgcccagacctcggtcaagcacggcagcccgaagaagaagcgcaaggtgggcagcgcggagtacgttcgggctctgttcgacttcaacggcaacgacgaggaggacctcccgttcaagaagggcgacatcctgcgcatcagggacaagccggaggagcagtggtggaacgccgaggactccgagggcaagaggggcatgatcccggtcccctacgtggagaagtacatgaccgacgcggagtatgtgcgcatccacgagaagctcgacatctacaccttcaagaagcagttcttcaacaacaagaagagcgtctcccacaggtgctacgtgctcttcgagctgaagaggcgcggcgagcgcagggcctgcttctggggctacgccgtgaacaagccgcagagcggcaccgagcgcggcatccacgccgagatcttcagcatccgcaaggtggaggagtacctcagggacaacccgggccagttcaccatcaactggtacagctcctggagcccgtgcgcggactgcgccgagaagatcctggagtggtacaaccaggagctgaggggcaacggccacaccctgaagatctgggcctgcaagctctactacgagaagaacgcgaggaaccagatcggcctgtggaacctccgcgacaacggcgtcggcctcaacgtgatggtctccgagcactaccagtgctgccgcaagatcttcatccagtccagccacaaccagctcaacgagaacaggtggctggagaagaccctgaagagggccgagaagcgcaggtccgagctcagcatcatgatccaggtgaagatcctccacaccacgaagtcccccgccgtgggcagcccgaagaagaagcgcaaggtgtccggcggcagcacgaacctgtccgacatcatcgagaaggagaccggcaagcagctcgtgatccaggagagcatcctcatgctgccggaggaggtcgaggaggtcatcggcaacaagcccgagtccgacatcctcgtccacacggcctacgacgagtccaccgacgagaacgtgatgctcctgacctcggacgctcccgagtacaagccatgggccctggtcatccaggacagcaacggcgagaacaagatcaagatgctctccggcggcagcccgaagaagaagcgcaaagtgtga

SEQ ID NO: 85 - protein, 2063 aa, Artificial Sequence
  Fusion protein
MSEVEFSHEYWMRHALTLAKRAWDEREVPVGAVLVHNNRVIGEGWNRPIGRHDPTAHAEIMALRQGGLVMQNYRLIDATLYVTLEPCVMVSFCFYLYIYNNYHLVVIYFKYFFQNKRMYIAIAFLFISVYILIYNFSNIPKFVDVQCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDGGGGSGGGGSGGGGSGGGGSGGGGSGGGGSMSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIARGERNLLYIVVVDGKGNIVEQYSLNEIINNFNGIRIKTDYHSLLDKKEKERFEARQNWTSIENIKELKAGYISQVVHKICELVEKYDAVIALADLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVAFLISPVKNSDGIFYDSRNYEAQENAILPKNADANGAYNIARKVLWAIGQFKKAEDEKLDKVKIAISNKEWLEYAQTSVKHGSPKKKRKVGSAEYVRALFDFNGNDEEDLPFKKGDILRIRDKPEEQWWNAEDSEGKRGMIPVPYVEKYMTDAEYVRIHEKLDIYTFKKQFFNNKKSVSHRCYVLFELKRRGERRACFWGYAVNKPQSGTERGIHAEIFSIRKVEEYLRDNPGQFTINWYSSWSPCADCAEKILEWYNQELRGNGHTLKIWACKLYYEKNARNQIGLWNLRDNGVGLNVMVSEHYQCCRKIFIQSSHNQLNENRWLEKTLKRAEKRRSELSIMIQVKILHTTKSPAVGSPKKKRKVSGGSTNLSDIIEKETGKQLVIQESILMLPEEVEEVIGNKPESDILVHTAYDESTDENVMLLTSDAPEYKPWALVIQDSNGENKIKMLSGGSPKKKRKV

SEQ ID NO: 86 - DNA, 6201 bp, Artificial Sequence
  Synthetic
atgccgaagaagaagcgcaaggtcatgaccgacgcggagtatgtgcgcatccacgagaagctcgacatctacaccttcaagaagcagttcttcaacaacaagaagagcgtctcccacaggtgctacgtgctcttcgagctgaagaggcgcggcgagcgcagggcctgcttctggggctacgccgtgaacaagccgcagagcggcaccgagcgcggcatccacgccgagatcttcagcatccgcaaggtggaggagtacctcagggacaacccgggccagttcaccatcaactggtacagctcctggagcccggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaatttgttgatgtgcagtgcgcggactgcgccgagaagatcctggagtggtacaaccaggagctgaggggcaacggccacaccctgaagatctgggcctgcaagctctactacgagaagaacgcgaggaaccagatcggcctgtggaacctccgcgacaacggcgtcggcctcaacgtgatggtctccgagcactaccagtgctgccgcaagatcttcatccagtccagccacaaccagctcaacgagaacaggtggctggagaagaccctgaagagggccgagaagcgcaggtccgagctcagcatcatgatccaggtgaagatcctccacaccacgaagtcccccgccgtggcggagtacgttcgggctctgttcgacttcaacggcaacgacgaggaggacctcccgttcaagaagggcgacatcctgcgcatcagggacaagccggaggagcagtggtggaacgccgaggactccgagggcaagaggggcatgatcccggtcccctacgtggagaagtacatgtccgaggtggagttcagccacgagtactggatgaggcacgctctcaccctggctaagagggcgtgggacgagagggaggtgccggtgggcgccgtgctcgtccacaacaaccgcgtgatcggcgagggctggaacaggcccatcggcaggcacgacccaaccgctcacgccgagatcatggctctcaggcagggcggcctggtcatgcagaactacaggctgatcgacgcgaccctctacgtgaccctcgagccctgcgtcatgtgcgcgggcgccatgatccactccaggatcggcagggtggtcttcggcgctagggacgccaagacgggcgctgcgggcagcctcatggacgtgctgcaccaccccggcatgaaccaccgcgtcgagatcaccgagggcatcctcgcggacgagtgcgctgcgctcctgtccgacttcttcaggatgcgcaggcaggagatcaaggcccagaagaaggcgcagtccagcaccgactccggcggctccagcggcggctccagcggcagcgagaccccgggcacgtccgagagcgcgacgcccgagagcagcggcggctccagcggcggctcctcggaggtcgagttcagccatgagtactggatgaggcatgccctgactctcgctaagagggcgcgggatgagcgcgaggtgccggtgggggccgtgctcgtcctgaacaaccgcgtgatcggggagggctggaaccgggctatcggcctccacgacccaacggcccatgccgagatcatggccctgaggcagggcggcctggtcatgcaaaactacaggctcatcgacgccaccctctacgtgaccttcgagccatgcgtgatgtgcgcgggggccatgatccactcgaggattgggagggtggtcttcggcgtgcgcaacgctaagacgggggccgccggcagcctcatggacgtcctgcactacccgggcatgaaccacagggtggagattaccgagggcatcctggccgatgagtgcgccgcgctcctgtgctacttcttccgcatgcccaggcaggtcttcaacgcgcagaagaaggcccagagctccactgatgggggcgggggctcaggcgggggcgggagcggcggcgggggctctgggggcggcggcagcggcgggggcggcagcgggggcggcgggtcgatgagcaagctggagaagttcacgaactgctactccctcagcaagaccctgaggttcaaggcgatcccggtcggcaagacccaggagaacatcgacaacaagcggctgctggtggaggacgagaagagggctgaggactacaagggcgtgaagaagctcctggaccgctactacctgtccttcatcaacgacgtgctccacagcatcaagctcaagaacctgaacaactacatcagcctcttcaggaagaagacgcgcaccgagaaggagaacaaggagctcgagaacctggagatcaacctgaggaaggagatcgccaaggcgttcaagggcaacgagggctacaagtccctcttcaagaaggacatcatcgagacgatcctcccggagttcctggacgacaaggacgagatcgccctggtcaactccttcaacggcttcaccacggcgttcaccggcttcttcgacaaccgcgagaacatgttcagcgaggaggccaagtccacgagcatcgcgttcaggtgcatcaacgagaacctcacccgctacatctccaacatggacatcttcgagaaggtcgacgcgatcttcgacaagcacgaggtgcaggagatcaaggagaagatcctgaacagcgactacgacgtcgaggacttcttcgagggcgagttcttcaacttcgtcctcacgcaggagggcatcgacgtgtacaacgccatcatcggtggcttcgtgaccgagtccggcgagaagatcaagggcctgaacgagtacatcaacctctacaaccagaagaccaagcagaagctgccgaagttcaagcccctgtacaagcaggtgctctccgacagggagtccctcagcttctacggcgagggctacacgagcgacgaggaggtcctggaggtgttccgcaacaccctcaacaagaacagcgagatcttctccagcatcaagaagctcgagaagctgttcaagaacttcgacgagtactccagcgccggcatcttcgtcaagaacggcccggcgatctccacgatcagcaaggacatcttcggcgagtggaacgtgatccgcgacaagtggaacgccgagtacgacgacatccacctcaagaagaaggcggtggtcaccgagaagtacgaggacgacaggcgcaagtccttcaagaagatcggctccttcagcctcgagcagctgcaggagtacgccgacgcggacctgagcgtggtcgagaagctcaaggagatcatcatccagaaggtcgacgagatctacaaggtgtacggctccagcgagaagctcttcgacgcggacttcgtcctcgagaagtccctgaagaagaacgacgccgtggtcgcgatcatgaaggacctcctggactccgtgaagagcttcgagaattacatcaaggccttcttcggcgagggcaaggagacgaacagggacgagtccttctacggcgacttcgtcctggcctacgacatcctcctgaaggtggaccacatctacgacgcgatccgcaactacgtgacccagaagccgtacagcaaggacaagttcaagctctacttccagaacccccagttcatgggcggctgggacaaggacaaggagacggactacagggcgaccatcctgcgctacggcagcaagtactacctcgccatcatggacaagaagtacgcgaagtgcctgcagaagatcgacaaggacgacgtcaacggcaactacgagaagatcaactacaagctcctgccgggccccaacaagatgctcccgaaggtgttcttctccaagaagtggatggcctactacaaccccagcgaggacatccagaagatctacaagaacggcacgttcaagaagggcgacatgttcaacctgaacgactgccacaagctcatcgacttcttcaaggactccatcagccgctacccgaagtggtccaacgcctacgacttcaacttcagcgagaccgagaagtacaaggacatcgcgggcttctaccgcgaggtcgaggagcagggctacaaggtgtccttcgagtccgccagcaagaaggaggtcgacaagctggtggaggagggcaagctctacatgttccagatctacaacaaggacttctccgacaagagccacggcacgcccaacctgcacaccatgtacttcaagctcctgttcgacgagaacaaccacggccagatcaggctgtccggcggcgccgagctcttcatgaggagggcgagcctgaagaaggaggagctggtggtccaccccgctaacagcccaatcgcgaacaagaacccggacaaccccaagaagaccacgaccctgtcctacgacgtgtacaaggacaagaggttcagcgaggaccagtacgagctccacatcccgatcgcgatcaacaagtgccccaagaacatcttcaagatcaacaccgaggtccgcgtgctcctgaagcacgacgacaacccctacgtgatcggcatcgctaggggcgagaggaacctcctgtacatcgtggtcgtggacggcaagggcaacatcgtggagcagtactccctcaacgagatcatcaacaacttcaacggcatcaggatcaagacggactaccacagcctcctggacaagaaggagaaggagaggttcgaggcccgccagaactggacctccatcgagaacatcaaggagctgaaggcgggctacatcagccaggtcgtgcacaagatctgcgagctcgtcgagaagtacgacgccgtgatcgccctcgcggacctgaactccggcttcaagaacagccgcgtcaaggtggagaagcaggtctaccagaagttcgagaagatgctcatcgacaagctgaactacatggtggacaagaagtccaacccctgcgctacgggcggcgcgctgaagggctaccagatcaccaacaagttcgagagcttcaagtccatgagcactcagaacggcttcatcttctacatcccggcgtggctcacgtccaagatcgaccccagcaccggcttcgtcaacctcctgaagacgaagtacacctccatcgccgacagcaagaagttcatctccagcttcgaccgcatcatgtatgtgccggaggaggacctgttcgagttcgccctcgactacaagaacttctcccgcacggacgcggactacatcaagaagtggaagctgtacagctacggcaaccgcatccgcatcttcaggaaccccaagaagaacaacgtcttcgactgggaggaggtgtgcctgacctccgcgtacaaggagctcttcaacaagtacggcatcaactaccagcagggcgacatcagggctctcctgtgcgagcagagcgacaaggccttctactccagcttcatggcgctgatgtccctcatgctgcagatgaggaactcgatcaccggcaggacggacgtggccttcctcatctccccggtgaagaacagcgacggcatcttctacgactccaggaactacgaggcccaggagaacgcgatcctcccaaagaacgcggacgccaacggcgcctacaacatcgccaggaaggtcctctgggctatcggccagttcaagaaggcggaggacgagaagctggacaaggtgaagatcgccatcagcaacaaggagtggctcgagtacgcccagacctcggtcaagcacggcagcccgaagaagaagcgcaaggtgtccggcggcagcacgaacctgtccgacatcatcgagaaggagaccggcaagcagctcgtgatccaggagagcatcctcatgctgccggaggaggtcgaggaggtcatcggcaacaagcccgagtccgacatcctcgtccacacggcctacgacgagtccaccgacgagaacgtgatgctcctgacctcggacgctcccgagtacaagccatgggccctggtcatccaggacagcaacggcgagaacaagatcaagatgctctccggcggcagcccgaagaagaagcgcaaagtgtga

SEQ ID NO: 87 - protein, 2060 aa, Artificial Sequence
  Fusion protein
MPKKKRKVMTDAEYVRIHEKLDIYTFKKQFFNNKKSVSHRCYVLFELKRRGERRACFWGYAVNKPQSGTERGIHAEIFSIRKVEEYLRDNPGQFTINWYSSWSPVSFCFYLYIYNNYHLVVIYFKYFFQNKRMYIAIAFLFISVYILIYNFSNIPKFVDVQCADCAEKILEWYNQELRGNGHTLKIWACKLYYEKNARNQIGLWNLRDNGVGLNVMVSEHYQCCRKIFIQSSHNQLNENRWLEKTLKRAEKRRSELSIMIQVKILHTTKSPAVAEYVRALFDFNGNDEEDLPFKKGDILRIRDKPEEQWWNAEDSEGKRGMIPVPYVEKYMSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDGGGGSGGGGSGGGGSGGGGSGGGGSGGGGSMSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIARGERNLLYIVVVDGKGNIVEQYSLNEIINNFNGIRIKTDYHSLLDKKEKERFEARQNWTSIENIKELKAGYISQVVHKICELVEKYDAVIALADLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVAFLISPVKNSDGIFYDSRNYEAQENAILPKNADANGAYNIARKVLWAIGQFKKAEDEKLDKVKIAISNKEWLEYAQTSVKHGSPKKKRKVSGGSTNLSDIIEKETGKQLVIQESILMLPEEVEEVIGNKPESDILVHTAYDESTDENVMLLTSDAPEYKPWALVIQDSNGENKIKMLSGGSPKKKRKV

SEQ ID NO: 88 - DNA, 6183 bp, Artificial Sequence
  Synthetic
atgtccgaggtggagttcagccacgagtactggatgaggcacgctctcaccctggctaagagggcgtgggacgagagggaggtgccggtgggcgccgtgctcgtccacaacaaccgcgtgatcggcgagggctggaacaggcccatcggcaggcacgacccaaccgctcacgccgagatcatggctctcaggcagggcggcctggtcatgcagaactacaggctgatcgacgcgaccctctacgtgaccctcgagccctgcgtcatggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaatttgttgatgtgcagtgcgcgggcgccatgatccactccaggatcggcagggtggtcttcggcgctagggacgccaagacgggcgctgcgggcagcctcatggacgtgctgcaccaccccggcatgaaccaccgcgtcgagatcaccgagggcatcctcgcggacgagtgcgctgcgctcctgtccgacttcttcaggatgcgcaggcaggagatcaaggcccagaagaaggcgcagtccagcaccgactccggcggctccagcggcggctccagcggcagcgagaccccgggcacgtccgagagcgcgacgcccgagagcagcggcggctccagcggcggctcctcggaggtcgagttcagccatgagtactggatgaggcatgccctgactctcgctaagagggcgcgggatgagcgcgaggtgccggtgggggccgtgctcgtcctgaacaaccgcgtgatcggggagggctggaaccgggctatcggcctccacgacccaacggcccatgccgagatcatggccctgaggcagggcggcctggtcatgcaaaactacaggctcatcgacgccaccctctacgtgaccttcgagccatgcgtgatgtgcgcgggggccatgatccactcgaggattgggagggtggtcttcggcgtgcgcaacgctaagacgggggccgccggcagcctcatggacgtcctgcactacccgggcatgaaccacagggtggagattaccgagggcatcctggccgatgagtgcgccgcgctcctgtgctacttcttccgcatgcccaggcaggtcttcaacgcgcagaagaaggcccagagctccactgatggcagcgcggagtacgttcgggctctgttcgacttcaacggcaacgacgaggaggacctcccgttcaagaagggcgacatcctgcgcatcagggacaagccggaggagcagtggtggaacgccgaggactccgagggcaagaggggcatgatcccggtcccctacgtggagaagtacatgaccgacgcggagtatgtgcgcatccacgagaagctcgacatctacaccttcaagaagcagttcttcaacaacaagaagagcgtctcccacaggtgctacgtgctcttcgagctgaagaggcgcggcgagcgcagggcctgcttctggggctacgccgtgaacaagccgcagagcggcaccgagcgcggcatccacgccgagatcttcagcatccgcaaggtggaggagtacctcagggacaacccgggccagttcaccatcaactggtacagctcctggagcccgtgcgcggactgcgccgagaagatcctggagtggtacaaccaggagctgaggggcaacggccacaccctgaagatctgggcctgcaagctctactacgagaagaacgcgaggaaccagatcggcctgtggaacctccgcgacaacggcgtcggcctcaacgtgatggtctccgagcactaccagtgctgccgcaagatcttcatccagtccagccacaaccagctcaacgagaacaggtggctggagaagaccctgaagagggccgagaagcgcaggtccgagctcagcatcatgatccaggtgaagatcctccacaccacgaagtcccccgccgtggggggcgggggctcaggcgggggcgggagcggcggcgggggctctgggggcggcggcagcggcgggggcggcagcgggggcggcgggtcgatgagcaagctggagaagttcacgaactgctactccctcagcaagaccctgaggttcaaggcgatcccggtcggcaagacccaggagaacatcgacaacaagcggctgctggtggaggacgagaagagggctgaggactacaagggcgtgaagaagctcctggaccgctactacctgtccttcatcaacgacgtgctccacagcatcaagctcaagaacctgaacaactacatcagcctcttcaggaagaagacgcgcaccgagaaggagaacaaggagctcgagaacctggagatcaacctgaggaaggagatcgccaaggcgttcaagggcaacgagggctacaagtccctcttcaagaaggacatcatcgagacgatcctcccggagttcctggacgacaaggacgagatcgccctggtcaactccttcaacggcttcaccacggcgttcaccggcttcttcgacaaccgcgagaacatgttcagcgaggaggccaagtccacgagcatcgcgttcaggtgcatcaacgagaacctcacccgctacatctccaacatggacatcttcgagaaggtcgacgcgatcttcgacaagcacgaggtgcaggagatcaaggagaagatcctgaacagcgactacgacgtcgaggacttcttcgagggcgagttcttcaacttcgtcctcacgcaggagggcatcgacgtgtacaacgccatcatcggtggcttcgtgaccgagtccggcgagaagatcaagggcctgaacgagtacatcaacctctacaaccagaagaccaagcagaagctgccgaagttcaagcccctgtacaagcaggtgctctccgacagggagtccctcagcttctacggcgagggctacacgagcgacgaggaggtcctggaggtgttccgcaacaccctcaacaagaacagcgagatcttctccagcatcaagaagctcgagaagctgttcaagaacttcgacgagtactccagcgccggcatcttcgtcaagaacggcccggcgatctccacgatcagcaaggacatcttcggcgagtggaacgtgatccgcgacaagtggaacgccgagtacgacgacatccacctcaagaagaaggcggtggtcaccgagaagtacgaggacgacaggcgcaagtccttcaagaagatcggctccttcagcctcgagcagctgcaggagtacgccgacgcggacctgagcgtggtcgagaagctcaaggagatcatcatccagaaggtcgacgagatctacaaggtgtacggctccagcgagaagctcttcgacgcggacttcgtcctcgagaagtccctgaagaagaacgacgccgtggtcgcgatcatgaaggacctcctggactccgtgaagagcttcgagaattacatcaaggccttcttcggcgagggcaaggagacgaacagggacgagtccttctacggcgacttcgtcctggcctacgacatcctcctgaaggtggaccacatctacgacgcgatccgcaactacgtgacccagaagccgtacagcaaggacaagttcaagctctacttccagaacccccagttcatgggcggctgggacaaggacaaggagacggactacagggcgaccatcctgcgctacggcagcaagtactacctcgccatcatggacaagaagtacgcgaagtgcctgcagaagatcgacaaggacgacgtcaacggcaactacgagaagatcaactacaagctcctgccgggccccaacaagatgctcccgaaggtgttcttctccaagaagtggatggcctactacaaccccagcgaggacatccagaagatctacaagaacggcacgttcaagaagggcgacatgttcaacctgaacgactgccacaagctcatcgacttcttcaaggactccatcagccgctacccgaagtggtccaacgcctacgacttcaacttcagcgagaccgagaagtacaaggacatcgcgggcttctaccgcgaggtcgaggagcagggctacaaggtgtccttcgagtccgccagcaagaaggaggtcgacaagctggtggaggagggcaagctctacatgttccagatctacaacaaggacttctccgacaagagccacggcacgcccaacctgcacaccatgtacttcaagctcctgttcgacgagaacaaccacggccagatcaggctgtccggcggcgccgagctcttcatgaggagggcgagcctgaagaaggaggagctggtggtccaccccgctaacagcccaatcgcgaacaagaacccggacaaccccaagaagaccacgaccctgtcctacgacgtgtacaaggacaagaggttcagcgaggaccagtacgagctccacatcccgatcgcgatcaacaagtgccccaagaacatcttcaagatcaacaccgaggtccgcgtgctcctgaagcacgacgacaacccctacgtgatcggcatcgctaggggcgagaggaacctcctgtacatcgtggtcgtggacggcaagggcaacatcgtggagcagtactccctcaacgagatcatcaacaacttcaacggcatcaggatcaagacggactaccacagcctcctggacaagaaggagaaggagaggttcgaggcccgccagaactggacctccatcgagaacatcaaggagctgaaggcgggctacatcagccaggtcgtgcacaagatctgcgagctcgtcgagaagtacgacgccgtgatcgccctcgcggacctgaactccggcttcaagaacagccgcgtcaaggtggagaagcaggtctaccagaagttcgagaagatgctcatcgacaagctgaactacatggtggacaagaagtccaacccctgcgctacgggcggcgcgctgaagggctaccagatcaccaacaagttcgagagcttcaagtccatgagcactcagaacggcttcatcttctacatcccggcgtggctcacgtccaagatcgaccccagcaccggcttcgtcaacctcctgaagacgaagtacacctccatcgccgacagcaagaagttcatctccagcttcgaccgcatcatgtatgtgccggaggaggacctgttcgagttcgccctcgactacaagaacttctcccgcacggacgcggactacatcaagaagtggaagctgtacagctacggcaaccgcatccgcatcttcaggaaccccaagaagaacaacgtcttcgactgggaggaggtgtgcctgacctccgcgtacaaggagctcttcaacaagtacggcatcaactaccagcagggcgacatcagggctctcctgtgcgagcagagcgacaaggccttctactccagcttcatggcgctgatgtccctcatgctgcagatgaggaactcgatcaccggcaggacggacgtggccttcctcatctccccggtgaagaacagcgacggcatcttctacgactccaggaactacgaggcccaggagaacgcgatcctcccaaagaacgcggacgccaacggcgcctacaacatcgccaggaaggtcctctgggctatcggccagttcaagaaggcggaggacgagaagctggacaaggtgaagatcgccatcagcaacaaggagtggctcgagtacgcccagacctcggtcaagcacggcagcccgaagaagaagcgcaaggtgtccggcggcagcacgaacctgtccgacatcatcgagaaggagaccggcaagcagctcgtgatccaggagagcatcctcatgctgccggaggaggtcgaggaggtcatcggcaacaagcccgagtccgacatcctcgtccacacggcctacgacgagtccaccgacgagaacgtgatgctcctgacctcggacgctcccgagtacaagccatgggccctggtcatccaggacagcaacggcgagaacaagatcaagatgctctccggcggcagcccgaagaagaagcgcaaagtgtga

SEQ ID NO: 89 - protein, 2054 aa, Artificial Sequence
  Fusion protein
MSEVEFSHEYWMRHALTLAKRAWDEREVPVGAVLVHNNRVIGEGWNRPIGRHDPTAHAEIMALRQGGLVMQNYRLIDATLYVTLEPCVMVSFCFYLYIYNNYHLVVIYFKYFFQNKRMYIAIAFLFISVYILIYNFSNIPKFVDVQCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDGSAEYVRALFDFNGNDEEDLPFKKGDILRIRDKPEEQWWNAEDSEGKRGMIPVPYVEKYMTDAEYVRIHEKLDIYTFKKQFFNNKKSVSHRCYVLFELKRRGERRACFWGYAVNKPQSGTERGIHAEIFSIRKVEEYLRDNPGQFTINWYSSWSPCADCAEKILEWYNQELRGNGHTLKIWACKLYYEKNARNQIGLWNLRDNGVGLNVMVSEHYQCCRKIFIQSSHNQLNENRWLEKTLKRAEKRRSELSIMIQVKILHTTKSPAVGGGGSGGGGSGGGGSGGGGSGGGGSGGGGSMSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIARGERNLLYIVVVDGKGNIVEQYSLNEIINNFNGIRIKTDYHSLLDKKEKERFEARQNWTSIENIKELKAGYISQVVHKICELVEKYDAVIALADLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVAFLISPVKNSDGIFYDSRNYEAQENAILPKNADANGAYNIARKVLWAIGQFKKAEDEKLDKVKIAISNKEWLEYAQTSVKHGSPKKKRKVSGGSTNLSDIIEKETGKQLVIQESILMLPEEVEEVIGNKPESDILVHTAYDESTDENVMLLTSDAPEYKPWALVIQDSNGENKIKMLSGGSPKKKRKV

SEQ ID NO: 90 - DNA, 23 bp, Zea mays
aatcaatgggaagcctatctacc

SEQ ID NO: 91 - DNA, 1284 bp, Artificial Sequence
  Synthetic
atgtccgaggtggagttcagccacgagtactggatgaggcacgctctcaccctggctaagagggcgtgggacgagagggaggtgccggtgggcgccgtgctcgtccacaacaaccgcgtgatcggcgagggctggaacaggcccatcggcaggcacgacccaaccgctcacgccgagatcatggctctcaggcagggcggcctggtcatgcagaactacaggctgatcgacgcgaccctctacgtgaccctcgagccctgcgtcatggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaatttgttgatgtgcagtgcgcgggcgccatgatccactccaggatcggcagggtggtcttcggcgctagggacgccaagacgggcgctgcgggcagcctcatggacgtgctgcaccaccccggcatgaaccaccgcgtcgagatcaccgagggcatcctcgcggacgagtgcgctgcgctcctgtccgacttcttcaggatgcgcaggcaggagatcaaggcccagaagaaggcgcagtccagcaccgactccggcggctccagcggcggctccagcggcagcgagaccccgggcacgtccgagagcgcgacgcccgagagcagcggcggctccagcggcggctcctcggaggtcgagttcagccatgagtactggatgaggcatgccctgactctcgctaagagggcgcgggatgagcgcgaggtgccggtgggggccgtgctcgtcctgaacaaccgcgtgatcggggagggctggaaccgggctatcggcctccacgacccaacggcccatgccgagatcatggccctgaggcagggcggcctggtcatgcaaaactacaggctcatcgacgccaccctctacgtgaccttcgagccatgcgtgatgtgcgcgggggccatgatccactcgaggattgggagggtggtcttcggcgtgcgcaacgctaagacgggggccgccggcagcctcatggacgtcctgcactacccgggcatgaaccacagggtggagattaccgagggcatcctggccgatgagtgcgccgcgctcctgtgctacttcttccgcatgcccaggcaggtcttcaacgcgcagaagaaggcccagagctccactgat

SEQ ID NO: 92 - protein, 422 aa, Artificial Sequence
  Synthetic
MSEVEFSHEYWMRHALTLAKRAWDEREVPVGAVLVHNNRVIGEGWNRPIGRHDPTAHAEIMALRQGGLVMQNYRLIDATLYVTLEPCVMVSFCFYLYIYNNYHLVVIYFKYFFQNKRMYIAIAFLFISVYILIYNFSNIPKFVDVQCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTD

What is claimed is:

1. A fusion protein comprising from the N-terminus to the C-terminus a heterologous TadA deaminase domain, a first linker sequence, and a Type V CRISPR-Cas protein, wherein the first linker sequence comprises the sequence GGGGS at least six times (SEQ ID NO: 11), wherein the Type V CRISPR-Cas protein is a catalytically inactive Cas12a, wherein the fusion protein comprises SEQ ID NO: 81.

\*　\*　\*　\*　\*